United States Patent 8,030,546 (BIOTIC AND ABIOTIC STRESS TOLERANCE IN PLANTS) - sequence listing, part 6

SEQ ID NO: 15776 - DNA, 797 bp, Gossypium hirsutum
  Predicted polypeptide sequence is orthologous to G772, G776
caaatttatcattttactcgtctctgctaaaccccaaaatgttgttttgaaatttcttgccatcgaagctatagtgacagcaccatctgcggcggcggagacgggaggttcagcgacggccttagcacctgggtttcgattccacccaacagatgaagagttggttagctattacttgaaaagaaaagttacaaacaagcctgtcagatttaacgctattgcagaagttgatatttacaagcacgagccttgggacctttcagacaagtcaagattgaaaaccagagaccaggagtggtatttttttagtttattggacaagaagtatgggaatggaggaagaatgaatagggccacaaaccaagggtattggaaggccacggggaaggaccgagaggtccgccacaatgatcagcttatggggatgaaaaagacactagtattccataatgggagagctccagatgggttgcgaaccaattgggttatgcacgagtatcgacttgttgaagaagaattagaaagaattgggacattgcaggggtatgtgctatgtagagtatttcataagaataacattggaccacccaatggaaaccgatatgcccctttcattgaggcagaatgggatgatggttcagcagctttagttccaggaatagatattggggatgatggtgtagcttctgagaaggcactggttgaaagcaatggtgttcaaagaagtggttttgagcaggagattcaaaatgcagatgaggaagctccagctaatgataaagttcggagggagttac

SEQ ID NO: 15777 - DNA, 857 bp, Gossypium hirsutum
  Predicted polypeptide sequence is orthologous to G773, G1412
gcggccccgtcgacttttaaactgaaactagatcttatatttgatacaattttaattatgctaaaaacacagagcaaaatttcaaattttggccatctttttaaactcttttggtttctataattccaaaaggttagcccaaaagaattcaaaatatttacacaatttctgaaattcctttcctggtccttctacctatactttctttttattgtctaaacccaaatccacccgattgagtcgggcaccgaaacccatacgggtcaatcgagttagagaagttgtgactgttcaacacattcgagttttgttgaaatatccccgagttatcagctcgctgagttctgagtccactctgtacttcctcttccaccgagttaccaatcttatttgtcgacacgtccatctgacaaagtgtaggcggcattgtgctgacatatacgttactatttccataactagtaatcccctgactctgagtttgagtttgagtttgtccactcggtaccagctcaggcaccgagctaagcccaccaagactcccccaatccaaattcccgatacccagactttgaaaccccagtttcacatcgttttggagcgttttgaacgagttaacgcgtggcaaagcaaagaaacgatcgtccaactcgggcaatgactcaagcatgtcatccagttgtgaagaagacgatgatgatgacccattcgtgctttgctctctgcttgaaacacttgacaaaggtttttgaccacttgaattcttcttgtatattcgacacaaaacccaatcatccaacttggagctaccacttttacgagaagtttcaatgagtcgatattcatgcataatccaa

SEQ ID NO: 15778 - DNA, 458 bp, Gossypium hirsutum
  Predicted polypeptide sequence is orthologous to G778
gaacttcatgggccgaccaaacatcattggtatctcacctgttttgtctaatcctttcatgacaatgaatacaccttgggatggttctaacaacaatgatcggttacaacaagctgcttcaatgacagaccctttatctacattccttgcttgtcaatcacaaccgatgactatggatgcttatagtagaatggccgctatgtatcaacaaatgcaacaaccgccagcttctagttcaaagagttaagctttcaatgtgcctttatttatacacaaaaagaaaaagaaaaaaacaacaacatgaactcggattataattctttagtttcaagtggttggttatatgttctttattttattttattacaaagctttgttttgtttgcaaattattgtctttgaatttgtaatattattaaatggttctcccatgagctaaaaaaaaaaaaaaaaaaaaa

SEQ ID NO: 15779 - DNA, 896 bp, Gossypium hirsutum
  Predicted polypeptide sequence is orthologous to G791
aattttctctcttgccaaacagaaactccattttctttgccaaaagccggaaatcaaaccaaacccttccaactttccggctaaaagcaagttcagtggagaatggtatcacctgaaaacgccaattattggtctagcttcgattatgcaaccttgatcaacgatatccctgcccctgacggaacttattccggattttcttggcccactcagccaatcaatgcctcttctaatgttttcagtgtggacattgacggctcgtttgaggattcagatggccttaaggaatctggttcaaagaagagggttagatccgaatcttgcaatgtttcaagctccaaagcatgcagggagaagttgcgtagggataggctaaatgagaagtttatggagctgacttctattttggaacctgaaaggcctccaaagacagacaaggctgctattttggttgatgctgtccgaatggtaacccagttacaaggtgaagcccagaaattgaaggattcaaattcaagtctccatgacaggattaaagaattgaaggctgaaaagaatgaacttcgtgacgaaaagcaaaggctgaaggcagagaaggaaaagctggagcaacagctgaaggccataaatgcacaacctagcttcatgcctcctgcacctgcattccctactgcatttgctactgcccaaggtcaagttccaggaaacaagttggttcctttctttggttatcctggagttgccatgtggcagtttatgccgcctgcatcggtagacacctcagaggatcatgtactccgccctccggttgcctaagccggcaacctacaatgatttgcgtttgcattttgatacaaagaagcgtatgcatttggtcattattctcagatgttcta

SEQ ID NO: 15780 - DNA, 862 bp, Gossypium hirsutum
  Predicted polypeptide sequence is orthologous to G791
ccaaatccaaagaaaatattccccacctttcctcaccatcacattcttccctcacagattcccccaaatcaaccaaattcactcgttccatatctccaatctatctctctgttctcttttgttttgttttcttcactttctgcatcaaacatcttccgctgtctggcataactgaatcctcgccgggaaaaatgatatcccggcggcaaccgggtgcggaggacctggtctcctctgacaatcccaatgcttggatttttgatgattatggtttgttagaagacattcctgtccctggtggtgatcttccctcacttgacccttcagccccaatctggtcatctccctcccttacttgctctgctcctctcagtgttgaattcactgaatcgtttgggaattcagacagtcttaatgaaacaggctcccgaaaaaggatgaggtctggatcatccagtgcatctgggtccaaagcttgcagagaaaagatgcgaagggataagctaaatgacaggttcctagaattgggttctattctagagcctggaaggtcttccaaagtggacaaggctgtaatattagttgacgctgctcggatggttactcaattacgggatgaggcccagaaactgagggagtcaaatgagagtctgcaggagaagattaatgagcttaaggctgaaaagaacgaacttcgtgatgagaagcagaggctaaagaccgagaaagataatctcgagcggcaagtaaaggcattaggttctcaaccaggattcgtacctcaggctcctgctattcctactccattttctaccccaagccaagttgttggtgggaaactggtgcctttcgttggctatcc

SEQ ID NO: 15781 - DNA, 938 bp, Gossypium hirsutum
  Predicted polypeptide sequence is orthologous to G791
ccaagatcaaagttggcggagaatggtgttccctgaaaactccaattattggtctcacttcgattatgctaccttgatcgacgatatccctgtccctgatgatccttatgccggttttgcttggtctacgcagccaatcgacgccccttctaatgttgtcagtgtggaaattgatggctcatttggagattcagacggtctcaaggaatctggttcaaagaagagggttagatccgaatcatgcaatgcatctagctccaaagcatgtagggagaaattgcgtagagataggctaaatgacaagtttatggagttgggttctattttggaacctggaaggcctcccaaaactgataagtctgctattttgattgatgctgtccgaatggtgacccagttacgaggtgaagcccagaaattgaaggattcaaatactagtctacaggaaaggattaaagagttgaagtctgaaaagaatgagcttcgtgacgaaaagcaaaggctgaaggcagagaaagaaaggctggagcagcaactcaaagcaatgaatgcacaacctagcttcatgccgcccgcaccaccagcaatccctgctgcatttgctgcggctccgggtcaagctcctgggaacaagttggtacctctcattggctatcctggagttgcaatgtggcagttcatgccgcctgcagcagtggatacttcacaggaccatgtcctccgccctccggttgcctaagttggcaaccaacaatgattggggttgcattttgatgcaatcaagggtataagttaatgttctgggctgtttagatttcactgaagtttttctaactggctttgttgggtgactgtcattgtactcctacgatttggtgctggtaatcacatgtaaatttctaataagttaatctggcaacctttgtttctctgtgttc

SEQ ID NO: 15782 - DNA, 380 bp, Gossypium hirsutum
  Predicted polypeptide sequence is orthologous to G791
agctgaatgcatgaatcacaaccagcttctgctcctgcactgcatccctgctgatttgtactgccaaagtcagtccaggaaacaagttggttcctttctttggttatcctggagttgccatgtggcagtttatgcctgctgcgtcgttagacacctcagaggatcatgtactccgccctccggttgcctaaggtggcaacctacaatgatttgggtttgcattttgatacaaagaagtgtatgcagttggtcattattctcagatgttctagttttaactgaagaaactaactggatttattgggtgactcaattgtaatgtaatgatttgaagctggtaaatcacttgtaaatttttagtaaaaaaaaaaaaaaaaaaa

SEQ ID NO: 15783 - DNA, 965 bp, Gossypium hirsutum
  Predicted polypeptide sequence is orthologous to G801
gttgtgtccattaatcttctccagcaattaccccataacagctagacaaagcttttatagtctttgaagcgaaaactaaagctaaactacataaagggtaagagtgtggtagtcctgctcctgcccccacgatgtccaattcagagactgctgctactaacggatcgttaatggacccacagagacatcaggcgccggcagccaatggttcacttgccgttaaaaagcctcccaccaaagaccgtcacagcaaagttgatggtcgtgggagaaggatcaggatgcccatcatttgcgccgctcgtgttttccagttgacccgcgaattgggtcataagtccgatggtcagactatcgagtggctgttgcgtcaggctgagccttctattatagccgccactggtacagggacgactcctgctagtttttccaccgtgtcggtttccctccgcggagctaattctacttctttgtcgtcgaccacttcttcgtctttggatcataagcctcttttgggtcctaccccgtttatactggggaaacgcgtccggtccgacgacgataacgccggaaaggacgatttcggagggctcactgttggaccaggcgtgggttccattgtgggaccgaacgggacacatccgggtgggttctgggctcttccagcaaggccagactttggtcaattgtggagcttcgcggccccgcctccgccggatatggtagtacaggcggctgctcagcaacccgctgctgctgctgcgttgttcgttcaacaacagcaagcgatgggagaagcgtcggcggctagggtcggcaattatcttcctggtcacctaaacttgttagcctcgttgtcagtgctccgggaggatcgggtcgaagagacgaggatccgcattaaaatttggtggaccattttacccttcctgttgttgggagtatatatagattctataaatatt

SEQ ID NO: 15784 - DNA, 895 bp, Gossypium hirsutum
  Predicted polypeptide sequence is orthologous to G801
agtttcagtccacaactgaactagaagggctatacaaacaaacaaattctgggtaagagtgtgctactcctgctcccaccatgtctaattcggagggtggtgccaccaacggagctataatggaccctcagagacagcaagccacggttaatggttcccttgccataacaaaacctccttctaaagaccgtcacagcaaagtcgacggtcgtggccgaagaatcaggatgcctatcatttgtgccgctcgtgttttccagttgactcgtgagttgggtcacaaatccgatggtcagacaatcgagtggctcttacgccaggctgaaccttccatcattgccgccactggcaccgggaccactcccgccagcttctccaccatgtctgtttccgtccgtggcggagccaattctacttctctatcgtccaccactgcttctccgtctttggatcataagcctttgttgggtcccaccccatttatactcgggaaacgtgtcaggcccgacgatgataaccccggaaagtatgataccggaggagtcatggtaggaccaggagttgtggggcccgctggtggattctgggctcttccaggcagggcagactttggtcaattgtggagtttcccgcccccagcggagatggcggctcatcaacctgctgctgcgttgttcgttcagcaacagcaagcgatgggagaagcgtcggcggctagagttggtaattatcttcctggtcatctgaacttgttagcctcgttgtcgggtgctccaggaagttcgggtcggagaggcgaggatcctcgttgaatttggctggacaagtttacccctgttatcgggagtatatatatagcttggttttgatgtgtgtgatgtggaagagggttttt

SEQ ID NO: 15785 - DNA, 976 bp, Gossypium hirsutum
  Predicted polypeptide sequence is orthologous to G801
cagccaatcttttcagcttaaccccccccccaaaaaaaaaagaaaaagaaaaaaactaagtgagaacattttcagtgagcctagttgaaattgtatacagttttggggttttgtttggtgccgcatgtcaaattcagaggctgctgctaaaaacggagcaacaatggatacccagagacaacaagcgccggggaacggtgcccttgccgtcaagaaacctccctccaaagaccgtcacagtaaagtagacggtcgtggacggaggataaggatgcccatcatttgcgccgctcgtgttttccagttgactcgcgagttgggtcataagtccgacggtcagaccatcgagtggctgttacgccaggccgagccttccatcatagccgctacaggtacggggacgactccagccagcttctccacagtgtcagtttccgtccgcggcggagccaattccacttctttgccgtcaacgacttcttcgtcgttggattataagcctttgttgggttccaccccttttttactcggaaaacgtgtccggcccgacgacgataacgccgggaaggacgattccagaggggccacggtgggaccgggcgtggggtctatcgtggggcccgctggaacggacacgggtgcgttctgggctgttccagctaggcctgactttggtcaaatatggagcttcgcgcccccgcctcctcccgagatggtggtacaaacagcggctcagcaaccagctgcagctgcgtttttcgttcagcaacagcaagcgatgggtgaagcgtcggcggcgagggttggcaattatcttcccggtcatctgaatttgttagcctccttgtcgggtgctccgggaggttcgggtcaaagagacgatgaccctcgttgaatttgggtggactgttttacccttgttgttgggagtatatatatttatatgaatacatagattctataaatatttgtgtat

SEQ ID NO: 15786 - DNA, 866 bp, Gossypium hirsutum
  Predicted polypeptide sequence is orthologous to G802
ccctcacgcgtccgcttttgatggcaccaccaccacatcttcagctccttcttctactagcaacaacaacaatagcccttttaatataacctccatatctcaccttcaccgccgtcttcttcatcctactacttcttcaacagccaccgttataaccactgcaacgccgcctctttcttcttcttcttcttcctcctcttccactactaagactaaccctgctcagccggttgatgcttcactagctattgctaccagatctagcgcttcccttaacatcgatgattctacaaagaagaatcaacccaacttgccaccgtcgtcgaacccaccggcgaaacggtccactaaagaccgtcacacgaaggtggatggtcggggacggcgtataagaatgcctgcagcttgtgcagctagggtttttcagttgactagagagttgggtcataaatctgatggtgaaacgattgaatggcttttacagcaggctgagccggcgatcattgcagccaccggaactggtactataccggccaatttttcgactcttaacgtttcgttgagaagtagtgggtctacgctttcagctccaccgtcgaaatctgctcctcactcgttccatggtgctttagctttggcttctcatcatcacccatatgaagaagggtttgctcatagcgctttgttcggtttccaccatcaacagcaacagctgttaagggcaggtcaaatagctgaaactttacctgcaggtggcagtggtagcggtggtggtgggaattcaagtgagaactatatgaggaagcgttttagggaggacttgttcaaggatgataaccaacaacaaggagaaaccggtgacggcg

SEQ ID NO: 15787 - DNA, 861 bp, Gossypium hirsutum
  Predicted polypeptide sequence is orthologous to G802
ccctacgcgtccgtgatcagcaacaaggtgaaagtggtagtcgtggcggcgatggatcccctattaaggctttcaaaagtggtttaactcaattgtctaaaccacaacaagatgctggatcttcggctctacctcgaccctcaaatatcctgcccggcacagccatgtgggcagtggcaccagcaccaagcagtggggcgggaagtacgttttggatgctgccaatgagtgctggtgctggtggcccatcagtggcgccttcagctgcaactggggctggtccatctgatcaccctcagatgtggccttttgggacagcaaatcaagctagtggaaatacactgcaagcgcctttacattttctaccaagattcaatcttccaggtaatgttgaattccaaggtggtagagctagtcctttgcaattgggttcaatgttaatgcagcagcaacaccaacaacaacagcctcatcatcaccttggtttaggaatgtctgattctaatttaggcatgttggcggctcttaatgcgtattctagaggtggctcaaacgttaactcagaccaaaacaatccactggaacatcatcaccaacaacaccagcctcaaggtacagacagtggagatgaccaagaccctaatacttctcaatgatgctcagagaattaaatatacagaacttggttagtaggctttttaattccctattgagtgcctgccttccatttatttctttttttcccttgagaaattgaatgcgttccagcatataaacagcaactggaaactagagagtgttgggtttgttttgtgcagatatggaacatcaagtttgtgatcatcagctgattacttgaaa

SEQ ID NO: 15788 - DNA, 940 bp, Gossypium hirsutum
  Predicted polypeptide sequence is orthologous to G802
ccccaccaaatggaacttacagatttgcaaagcaataagcaaaccaaaaacaacagcagcagcagcaacaataacaacaacaattctgcagaaccccaccatcagtctctccagcagcaccatctgcaacaccaaaaacagtcggcttctccccagcttgtggtcccttttgatggcaccagatcttcaggtccttcttcgggcaacccttttaatatgggctccatttctcacctccatccccaccacccttttcatcatcttcttcttcatcctgcttcttccacaactaccaccaccacaacaccgcctctcccgtcttcatcttcttcttcttcctcctcttcttcagcttctacgactacaacgaacccacctcaactcgttgacgcctctctcgctattgctaccagatctacttctctcaacatcgattccaagaatcaaaccgacttgccaatttcatctacgacgacaccagcatcgacgacgacgacgacgactacagctaacccgccagtgaaacgctccaccaaggaccgacacaccaaagtcgatggtcgaggccgccgtatcagaatgccagctacttgtgcggctagggttttccaattgactagagaattaggtcataaatctgatggggaaaccatcgaatggcttttacaacaagctgaaccagcaataatagcagccactggaactggtactataccagccaatttttcgactcttaatatttctttaagaagtagtggatccacgctttctgctccgccttcaaaatctgctccacactcgttccatggtgctttagctttggcttcccatcatcatcaccatcacccttatgaagaaggtttgctcatagcgctttgttggggtttcagcagcagcatcttttaacggcagatcaaatagctgaagctttacccggagt

SEQ ID NO: 15789 - DNA, 993 bp, Gossypium hirsutum
  Predicted polypeptide sequence is orthologous to G805
gggaattccaagctacacaacacaacatcatatagcaaaaatgaaggagacccactaggccatcaaagtcactgaattgagggtcaccttcagatcatgtactaggagagccaaaccaccaaaaagatataatcccactctctcatacatgatcatggatgaaaatgggatccgcaggccgaactttcctcttcagctcctagaaaagaaggaacaacctcgttccgaccctgccgacgtcgacaccagctccaaaccaaccttggaacctccctccaagaaacctccacctaagaggacttcgaccaaggaccggcacaccaaagtggaaggccgaggccgtcgcatccgcatgccggctacgtgtgctgctagggttttccagctaacaagggagcttggtcacaaatcagatggtgaaaccattgagtggttgctccaacaagctgagcctgcggtttttgctgccacggggacaggtactatccctgcaaatttcacgtcccttaatatttcactaagaagttcaggttctagcatgtcggcttcatacttgaggaacacatatttcaatccaaattttaccacacaaaaattgaggacggggagtgaatgggatcaaaggaatgtccttgacgattcatctcaacaacaacaacagcaacgaagggttttatttcctggtgttgctttatcatctgaagattcattgaactttcctggtactagtagcactactttgaacgcgttcttgcaagctaagcaagagattcgggacgccgagtccgcggatactagtatagggaagaggaggccggagcagcaagaatcgccacaaaatcagggtgggaagttacttgatacaatctaatacgggttcgattccgacaagtcataatccgatcccggcgacattttggattggcaaccaagttatcagtgggagtggcactggggatcccatgtggacatttccttcaacaataacactaa

SEQ ID NO: 15790 - DNA, 414 bp, Gossypium hirsutum
  Predicted polypeptide sequence is orthologous to G807
tttttttttttttttttctacaagtgagaatctatatcctaaaattcatcaatggctaaaagagggatgtcacataacatactcttcttaaatgatatatattactattatgggtgtttcattggataacaaccatttggaagacatgttatgctattagaacaatgacattgtaaataactccttttaataacaaaagttcctcttttctacccaacttcacagatcattatcatcatcagcagcattaacctgcatacacagtttgtggggcatcagcctctctggctatctgttgtaagaaggcccatttgctctgtgagatgattcgtatgttgaatcctatcccatccattattcttccccaacagtaattcaggttcacaacttgctccattttctggagaactcgag

SEQ ID NO: 15791 - DNA, 909 bp, Gossypium hirsutum
  Predicted polypeptide sequence is orthologous to G807
ctcttgccatggcaaattcactcactcgctgatcttcaaatccatatttattttcttcgaaaactcttttccttaatttttcttatcactaaaatcctgtaatggattctcttcatgattcaatatcagcggcgaacgcggcggccactgccaacggcaacaccgtgcccccttttctcagcaaaacctacgatgtggtgaatgacccatcgaccgactccgtcgtgtcgtggagtagcggtaataacagttttgttgtctggaaagtgccggagtttgctagggatcttttgcccaagtattttaagcacaataacttctccagctttgtcaggcagctcaatacatatggttttagaaaagttgaccctgaccgctgggaattcgctaatgaggggttcctacgaggtcagaaacatctattgaaaactatcagcaggcggaaacctcctaacgtccagagtaatcagcaacctcaagttcagaactcatctgttggagcttgcattgaggtcgggaagtttggtctcgaagaggaggttgaaagacttaagagggacaagaatgttctcatgcaggaacttgttaggttgaggcagcagcagcaaacaacggatagccagttgcaaactgttggccagcgtgtacaggtgatggagcagaggcagcagcaaatgatgtcttttcttgccaaggccatgcaaagtccgagtttcttaggccagcttgtacagcagcaaaatgaaagcaacaggcgcattactggagcaaacaagaagaggagactccccaggcacgatgaagaaaatttagctggtgaaaatggtgccgtatctgctaaagggcagattgtaaagttccagccttcactgaatgagcagcgaagcgatgctgcaccagataatgaga

SEQ ID NO: 15792 - DNA, 629 bp, Gossypium hirsutum
  Predicted polypeptide sequence is orthologous to G839, G1196
gaatcagttgaaaatttctattatcatagttctctaaggcactaaagaacataaacttcctatagatctttaatggtgtatgtataagtttggttaccttcatcaccagaggataggttatcaaacaagttatccctggcaacagtagtagacagaagcagagaagagttataagttttactcgcaagaaatccttaccgatataatcacaatttcctatacttgtaggggccaccatctctcaaagaagatgacgatgatgatgaagacaaaccgttgcggttaaactcggccttgtccttcttaaatgccctttgaacgtcctccttaagctccctgaagcgtgatctctctatcttttgctcttccggggtccctgtctcaaggtaagacaaatcaggaaggtcatcctccatgaacttatcgagcacttctgagcaatgagggaaatagcgccgacccatctccactgttttcataagggcttgcatcctagcaagaagtctttgcttctgcataatgggtgtctcattcaaatcaacctgccttaagtttccatttgaaccttttgatggaaagccagtagctaactcggaggttgtttcggcatgtgctatgtcaatggcaag

SEQ ID NO: 15793 - DNA, 332 bp, Gossypium hirsutum
  Predicted polypeptide sequence is orthologous to G849
aatctcttcacgtaatgtgttttacacaactggcatatcttgtcagaaatagtcacatcggctgttactaaactatgtcactgttgtcaccaggataaatggaaaacattggttcacacagcaaaaatttcgccgcagcaaagacgaggggaaccggtaccccaagaactattggatcgggtcatggctgctcatgcttactggtctcagcatcaaactaaacaacaaggaaagcatcatcccggaactttgagaattactgactcccaagctgacagaatcggatttgcggtcgccattccgaccattacaatgtaaaaaaaaaaaaaaag

SEQ ID NO: 15794 - DNA, 772 bp, Gossypium hirsutum
  Predicted polypeptide sequence is orthologous to G849
aaagttctttgaccgtagctcgatagtaaattctgatggaggaatcagtagtgaaagtgtttgtaattcacccgagaaggttgctgatggagataagggtagttccgcggcaatgtcacatggagcatgtgggataccccccttgcttacaggtaacaaagcatctcaccagtccaaggattctcatgtgaaattcagcattaagtcctttagaattccggaactttatatcgaggtgccagaaagtgcaactgtcggttcactgaagaggacggtaatggaggcagtgactgccttacttggaggtggaattcgtgttggggtactacttcaagggaagaaggttcgagatgacagccgaactttatcgcagactggtatttcctgtgaagaaaatctggattctcttggtttcactttggagcctggtcctgcgaaagctcctccgccagtgtgctcggaagaaccacatcttctgatgtcatgtgaaaaaggccctcaacaactaacaagccttccagccactccggttgtagatacagcgattcccgatgccacacctgacccactgttactaaccgatacagcacatcctgtggatagtaatcatgaaccggtttcctcccaaactgacgttctaactgatcaaagtctatcggagtctagagctatagttcctgttccagcaatgaatgtcgaggcactagctgtcatccctgccagcccaaaagtccgaaaaaccgaacttgcacagcgtcgaactaggaggccc

SEQ ID NO: 15795 - DNA, 895 bp, Gossypium hirsutum
  Predicted polypeptide sequence is orthologous to G852, G2633
gttcgcctacaagatgtctcttcttgccagataagagattacttggaaatccaaagcccagatacactagactctgatttggataagatgaaactgaagcttaaagaactggagagagctctgcttgctgataatgatgttgatggggatgatgacatgtttggcactggtctaagcatggaagtagatggtgagtggtctgatcctatcaggatgggttctcatcacgactcgccaaaggagtcatcatcctcgggtacttatctcgatagcgttagtggtaacaaagaggtttcacatgtttcatctcagactcctaagcaaatgctgattgaatgtgctgctatactctcagaaggtcacattgaaaaagcttcagccataataaacgagcttcgccagaaggtctcgattcaaggagatccgccccagagaattgcagcctacatggtcgaaggccttgcagctcgcatggcagcatccggaaaatgtctttacaaagctttaagatgcaaagagcccccttcttctgataggcttgcagcaatgcaaatcctctttgaagtgtgcccttgtttcaagtttggatttatggcagcaaatggtgcaattattgaggcatttaaaggtgagaaaagagtacatataatagattttgatataagtcaaggtagtcaatatattacactgattcaaacaatagctaagctgccgggtaagccacctcatttgaggttaaccggagttgatgaccctgattcagtccaacgtcttaatggagcctcgaaattgtcggactaagacttgagaagctagcagaaatactcggtgtacctttcgagtttcgagcagttccctcaaggacttcacttgttgctccatctatgctggattg

SEQ ID NO: 15796 - DNA, 851 bp, Gossypium hirsutum
  Predicted polypeptide sequence is orthologous to G852, G2633
ctatttctaaatatgctcgtggtggtggattggaagcagttaaaagacgtttggaagcaatatctgagaagttcaatattccagttgagtttcagggaatgccagtttttgcaccagatatcacaagggacatgcttgatgtcaggcctggggaggctctggctgtcaacttccctctgcagctccatcacacccctgacgagagcgttgatgtgaacaatcctagggatgggcttctacgtatggtaaagtcactgtctcccaaggttaccacattggtagagcaagaatcaaacacgaacacggcccctttcctccccaggttcatagagactctggagtactacttggcaatgtttgagtccatagatgaaacactgccaagggacagaaaggaacgagttaatgtggaagaacattgcctggccagggatattgtgaatatcattgcttgtgagggaaaggagagggttgagcgtcatgaactctttggtaagtggaagtctagattaacaatggcaggatttcgacaataccctttaagctcttatgtcaattccgtgatacgaggcttgctgaggtgttactctaaacattataagctggtagagaaggatggtgctatgttgttggggtggaaggataggaaccttatatcagcttctgcttggcactgtgacagctgagtgagattcatacaaaggcagaaacgaaataatcagttgattttttctaataggtgacggatgataagataacttcatcccatggtactaatggacaatgatactgttgtatcagctgttgaaatatgttgaataacatccctatgatccaaaaggtgacatttt

SEQ ID NO: 15797 - DNA, 932 bp, Gossypium hirsutum
  Predicted polypeptide sequence is orthologous to G852, G2633
aaacaaatcatatgctgtctcatttccaacctgctttccatctctcaaaccctctgttttcttcaacttcaatttcaccaaaagctgaagattccttagaataaggtgcggtgcccccattgatttgatgttggaattgaatttgtcctttttttgaatttaagatcataaagagacagatggaaagaatctgggctgtcaaggctgaaggatcatgttggaaacagtcctgccagtctcgaatcctttgattgctccaacccccacaaggggacagaaactgttctggcaagctgtccatcaatgcaagcatcccagcaacacagaagctcagtcatggctagcagattgtaccatcaaataaagcaagaagtcgagcctgagccctactggttccctcaactcccacctactgacccctctctctgctatagtgacggattccacttctctgttgagagttccaatgaaaatttttgcactttggagtcatcctctgcaaatggcagttatactgcctacaactctacatcacttgtcggtttctcaccaaatggaagcccaatgtcacagcaagattctcagtcgtatccatccgacttgcatcactctcctgacaataatggtggctctcctattagtggttcctgcgtgaccgatgatgtaagtgatttgagggataagctgaaagagctggaaactgtgatgttgggccctgattctgatgttattgacagtaagacctcactagagatgggcacctggagacttgtaacagatgcaatctccagaggggacttaaaacaggtccttgtcttttgtgcaaaagccctgtcagataatgatctcttgatggcacagtggttaatggatgaattacgccgaatggagtcgtttctggggagccaatccagagttgggagcctacatgt

SEQ ID NO: 15798 - DNA, 954 bp, Gossypium hirsutum
  Predicted polypeptide sequence is orthologous to G852, G2633
caggatatgcttcttgtaactcttctctggaatccagcacttatttccatcaatcgagtccctcagtggactgcaggcgtgaaagcttactgatccattctgatggaacttcttatatagaagatgcaaattctagccacgaaatagtatatacttcgcaagagctaggaacagcagtcatggcacctgatggggccaatgaagtaaccaatacaccgcagacaaatggccagcgatacagggcatcgagtaaggactgccgaggatcttccatgtgtcaacctcagacaacctttgtttctaaccgtaggcagtcaactgaagctgctcatgtagagaaacgtttgactgcaatagaggatttatctttgcagagtattccaccagggaatctaaagcagttgttgattgcatgtgctaaaactctctctgaaaacaatatcgataaattcaatatgttgattgcaaaggccagggttgctgtgtctatctacggagaaccaatccagcgtcttggtgcttacatggtggaagggttggtagcaaggaaggaggcatcgggatctaacatatatcgagcccttcgttgccaagagccggaaggcaaggacttactcacatacatgcataccctttatgaaatttgcccgtacttgaagtttggatacatggctgccaatggggccattgctgaagcatgcagaaccgaagatcgcatccacattattgatttccagattgctcaggggaacacagtgggtgaccctcttgcaagcacttgcagccagaccaggcggagctccttatgtgcggattacaggaattgatgatcctgtttctaaatatgcccgtggtggtggattagaagctgtcgaaagacggctgatggcactatccgagcagtttggtgttccagttgagttccatggaatgccagtttttgcagcagatatc

SEQ ID NO: 15799 - DNA, 593 bp, Gossypium hirsutum
  Predicted polypeptide sequence is orthologous to G852, G2633
cttgaaaccttggtattcaacctggtgaagccattgctgtaaattttgccatgatgctgcatcacatgccagatgaaagtgtggacactcagaaccatcgggacagactgttgaggttggccaagagtttgtccccaaaggtggtgacgctcgttgagcatgaagcaaatacaaataccgcccccttcattccccgtttcctagagacaatgggttatttttcgtctatctttgaatcgattgatgttagcctgccaagagaacacaaggagcgaatcaacgttgaacagcactgtctggcccgggagattgtcaacattatagcatgtgaagggcaagagagagtggaacgttatgaactttttgggaaatggagatcaaggtttattatggctggctttacaccctctccattaagtccatttgtaaatgctaccatcaaaactctgctgcaaagctattgcgataagtatactcttgaagagagagatggcgttctttatctcggctggatggatcgagctataattgcttcttgtgcatggagatgttaaccgaaggatagctgtatttacatttcatctttggcatac

SEQ ID NO: 15800 - DNA, 837 bp, Gossypium hirsutum
  Predicted polypeptide sequence is orthologous to G852, G2633
tgagcaactggtggacatgattcctagattaacttgaaggatgtgcttattgcttgtggtcaagcgctttacgacaatgacatgtcgagagtggcaggtttaatgcatgtattggagaaaatggtttcagtatgtggggaaccactccaacgattgggcgcttatgttcttgaagggcttagagcgatgttggaatcatcggggagtaatatctacaaagccttaaaatgtcaagaacctacaagctcggaactaatgtcttacatgcatattctctttcgaatctgcccgtactacaagtttgcatacacatcagctaatgctgtcatcaaggaagtcatggaatacgagcagagaattcatatcattgatttccaaatagcacagggtacccaatggatgtaccttattgcagctctttcaaaacgccctggtgggcccccatttatccgtgtaactggtattgatgattctcagtcaaatcatgctcgaggcggtggacttagtattgtggtgcagaaactatcagaatttgctaagtcgtacattgtgcattcgagtttcatgatactagcgtgtctactaccgagattcacgtacagaatctcaacatttgtcccggggaagccctagccgtgtaattcccttttgtttggcgtccattgccgacgggagcgtatactttctcgacactagaacacctgtgttggttgtgtgatagttgtccccaaatttgcccttgttggccgtgttacccaccttcccttttctccgtatgggacttatttacagttttcgatctacgtattgcagggtaccaggctgtgaactgtgctg

SEQ ID NO: 15801 - DNA, 940 bp, Gossypium hirsutum
  Predicted polypeptide sequence is orthologous to G866, G883
cttctacttttcgccaggcttcaatgttttgttgacctctcaacttgcttagtttcctttggttgtcgtcgttgtttttcgtgaaaatggcggtggatctgatgagttttcctaagatggatgatcagatggccattcaggaggctgcaacgcaaggtatgaagagcatggagcacctgattagcctcctttctcaccagtctaaccgactcgactgcgctgaggttgccgatctcaccgtctctaagttcaaaaaggtcatctcactaattaacagaaccggtcacgctcggttcagacgtgcaccgattcagtcctcttccttttcctcatcgtcatcatccgctgcttctctaactgttactgattcccacaaggctctaactcgaactcctgccccggttgaaacaccgccgctgaccgtaaatccggcgccggttgaagctccaagtacggatcctgctagtttcgttcctttgcaaccccagagtttaacactcgattttacgaaaccttatttgtttagttcgaacactaaaagcactgagttggagttcacaaaagaaagcttcagcgtgtcgtcgaactcttcgtttatgtcttctgcgatcaccggagacggcagcgtttcgaacgggaagcaaggatcatctctatttttgacaccggcggcggccgtttccgcgggaaaaccaccactatcctctgctccattcaagaagaggtgccgcgaacatgagcactccgagaacgtctccggcaacggcaagtgtcactgctcaaagcgaaggaaaaacagggtgaaaaaagtaatcagagttccagccatcagttctaagatcgccgacattcccggcagacgagtattcatggaggaagtacggtcaaaaaccgatcaagggctcaccatacccacggggatattacaagtgtagtacgg

SEQ ID NO: 15802 - DNA, 893 bp, Gossypium hirsutum
  Predicted polypeptide sequence is orthologous to G866, G883
ctcaggcttcaataacttgctgacctctcaagttaccttccctgcaaagcttcgtttctgtttctttgacctcaaaatggcggtggatctgatgagttttccgaagatggatgatcagatggcggtacaagaggctgcatcgctaggcttgaagggcatggagcacctgatccgtctcctttctcaccagtccaacaacgtcgactgcaccgacctcgccgatctcaccgtctctaaattcaaaaaggtcatctcacttctcaacagaaccggtcacgcccggttcagacgcgggccgattcaacccctttcttcctcgtcttccccctcgacatcatcctctgcttctctgtctgttccgaattctcaaaacaatctaactctaacttctgctgcgatctcaacgccggcgaccataaatacggcggtggtcggtacttcggttatcagtccttctagcttcgttcaatcgcagccgcagagtttgactctggacttcacaaaacctaatttgtttggctccaacggtaaaagtaccgagttggagttcacaaaagaaagctttagcgtttcctctaactcttcgtttatgtcttctgccatcaccggagacggcagcgtctcgaacgggaagcagggatcatctctattcttggcgccggcgctggccgtttcgacgggaaagccgccgctatcgtcgacaccgttcaagaagagatgccatgaacatgaccactccgataacgtttccggcaagatatctggctccggcaacagcaagtgccattgctcaaagcgaagaaaatagggtgaagaaagtaataaagggttcctgccataagttcgaagatcgccgatattccaccagacgagtattcatggaggaaatacgg

SEQ ID NO: 15803 - DNA, 789 bp, Gossypium hirsutum
  Predicted polypeptide sequence is orthologous to G872
attaaaacaataaacagtaatccatccaattactacaaaaaattacacacgaaaaagaagaaaaataaaaaattttataaactttacattcgttttacggagtaagctattataattgctgcttttaaggatgagcaaagaaggatggccgtacaaaaattggccctctcgaatatccggatccaactctggatactaaaatgcccaggtcgacccgattttagaaattccaaagaaaagattctggaactaaaatcccatccaaataatcctcttcgtacccgatgctgggcaacgatgatccgagaaaagcacttgagaaatcctcaaatccagggaatagcaacccataatccgattcataattacccgaaccgattgtcaaaagatccagaaacgacccgtccataggcaactcactatctaactgaacagtcccgtccgaaaccgacggtgatggggactccgtttggaacccagagttggattgctcggattggatcctgggaggctccgagttcgcaaactgtgctgcagcggcttgaatttggggcggcgttaaagacctagctccagctatctcgggagggttatcagggaagttgaatttggcagagaggccgcgtaagcaaaaaagagcggcgtcgaaagcacgcgctgctttctcggctgagtcataagatcccagccaaatcctttccctgctgttgggtagtctgatttcggacacccatttcccccattttcgctttcggacacccttgaaccgtgaatcgcttcgctccactg

SEQ ID NO: 15804 - DNA, 854 bp, Gossypium hirsutum
  Predicted polypeptide sequence is orthologous to G872
gcaacaaattgactttcaattgatggtgaagccaatctgcacaacacattcttcagcatcacaaacagagtatgcctccgacataaacaccaacagctgcagcagtaatagcagtagcagtagcagtagttccaagtataagggagtacggaagaagaaatgggggaaatgggtgtccgaaattcgacttcccaacagccgtgagcgtatttggttaggttcttacgactcgccggaaaaagcagccagggcgttcgacgcggctctttattgtttacgtggccgtgatgccaagttcaatttccctgaaaatccaccagaaatcgccggtgggacgtcgcttagcccgccggaaattcaagtggtggcagctaggttcgccaaaggggtggaactggaaaccccggggaataacaacagtattttagggacagaagagtatacatcgtcttcgtcgggcgggggagcgacaacgcaagtggagagtcgtcatcatgaaaaagacatgatggactggtcgtttttgagcatgttggataataacaacaccaatgatggagggatgtccgattatggcttttattcaaatttgggccatttgcctggtggtgatgatgatcaactctatcctccgccgattgatgatgatgaaaacggtggcagcgctttttcaccgtcatcgtttctttggaacttttaagccaaatttagatttctttttaaaagcaaataaggttaacttttgtgtttatttgtttgatgggataaatcaaaggcgtttggcgaatattagcagccaggatcggtgattttcccacagatacagtgagatgatgagattccattgatagaaa

SEQ ID NO: 15805 - DNA, 627 bp, Gossypium hirsutum
  Predicted polypeptide sequence is orthologous to G872
tccctgatacccacccgagatagccggcggtacgtctttatctccccatgaaatccaagccgccgcagcgaggttcgcgaactcggagccttcgacgatccattcggagcaaactgattctgcgttccaaatggagtcaccgtcgccgtcagtttcggacgcgacggtacaattcgacgggtcggctatggatctattgacgatgggttcgggtaatggtgtttcggattatgggattttccctggatttgatgatttttcaagtgatgttttgggatcatcgatgcttaacattggtgatgaagatgaaaattttgatgggattttgattccgggatcatttctttggaatttttagaacggatcaacttaaatccggggatttttagtatccggatttggacccggatatttggatgggtcaaatttttttcacggctcattcttttttttattaaagaaaacaaaacaaaataaaaatcaagtattaattaatttgtagagaagaatgtaaagtaaagcattgtagactttttgggtaattttttgtaataattgatttttttagtgtcaacgttaaatatattttaaatagttattttatggaaaaaaaaaaaaaaaaaaaaa

SEQ ID NO: 15806 - DNA, 550 bp, Gossypium hirsutum
  misc_feature (20)..(21): n is a, c, g, or t
  misc_feature (441)..(441): n is a, c, g, or t
  misc_feature (460)..(460): n is a, c, g, or t
  misc_feature (485)..(485): n is a, c, g, or t
  misc_feature (539)..(539): n is a, c, g, or t
  misc_feature (541)..(541): n is a, c, g, or t
  misc_feature (547)..(547): n is a, c, g, or t
  Predicted polypeptide sequence is orthologous to G878
gggccccctcgcgttttttnnttttttttaaaagacactaaaacaagcttatcagcagttctaccccacactcaaaagagagaaaaagggctaacaaaatcgtttgctcacaaaatagtccaaaagcaaaagtggataaatttttgtatcagattcagcccctatatacatgagaatgagttaaaatatatgaaaaagaagggagagaaatctgttgtacacacctgatattgagaatgccatttttttaaaaatctcttttattttttttttgaaggaaagtcacccttcttttacttctaagaagaggggtcctttcataaatgcaaagcaaattaagctaaatatgtccataagctgctgtaagtctttggatgtccttcgcacacatatcggaattttgtaaagctgcttcttgttgttgctgctgctgctgctgtnggttaagagaccacacggntgtttgatgaagtattacgtgcacncgaaatctgtatctgattattatctcgatattgcacgacaggactgtggggtancngatttngca

SEQ ID NO: 15807 - DNA, 255 bp, Gossypium hirsutum
  Predicted polypeptide sequence is orthologous to G881
gtggatactacgctggacctcaacatcaatcctttccatcaccggaacaaagctctgaggaccgaatctgagggagaaatggctgactctgatgtgaagctacccttcaaacaagagaatgcagttttggtggaggaattgaatcggattaaagctgagaacaagaagctaactgagatgttaacagttttgggtcactgctacaacgatttgcagaacaagttcatggaattagtgaccattaactctgaaaat

SEQ ID NO: 15808 - DNA, 863 bp, Gossypium hirsutum
  Predicted polypeptide sequence is orthologous to G881
gcggccgcgctcgacaaaacctttcactctctcttcctcatcgtttcttcagagcttcagctccatcgcctgcctctttgcttcttcttttcttgttctatagtgtaatttcggtgatggaatcggcttgggtggatacgactctcgacctcaacatcaatccttcccataataccatcaaagttctgaagagagaatccagtggaaaactggctgattctgatgtgaaagtaccagttaaacaagagaccggagctttgttggaggaattgaaccggattagcgctgagaacaagaagctaactgagatgctaacagttttatgcgagcgctacagctctttgcagaaccaatacatggaattggtgagcaggaactcgggaagtgatgcaacagctgcaacatcaaaaaagagaaaagccgagtgtgaggattatgccaccatgattggattcagtggaaaagctgagagcagctgcagtgatgaagactcgtgcaaaaagcctaaggactgcatcaaagcaaaaatttcaagggcttacgtgcgcacaaatccttctgataacagcctgattgtgagagatggatatcaatggagaaaatatggtcaaaaggttacaagagataatccctctccgagggcatacttcaagtgctccttcgccccaagttgtcccgtcaagaaaaaggtgcaaagaagtgctgaagatccatcaatcttggttgctacttatgaaggagagcacaaccatgaacaacactctccaccagcattatcatcattaagccccaacagtggtaccagtaaccctcgttcagctcctgtttcttctttctcttctgccccccgccaatcttcacct

SEQ ID NO: 15809 - DNA, 793 bp, Gossypium hirsutum
  misc_feature (785)..(785): n is a, c, g, or t
  Predicted polypeptide sequence is orthologous to G881
gcttggtaccgagctcggatccactagtaacggccgccagtgtgctggaattcgccctttcgagcggccgcccgggcaggtacacatacacaccttaacctaatgctttaaagaaatgttattttagtttgttggtggtttagggtgctcagtaatggagctgagcgacagcatgcggctaaagctagagtgaagctaggatcttttgctaaggatgctgcaacatggtcttccattgatctcttgttgttataatcgtcatcgttgccgatgccgcagctgttttcgcttgaaagattgagatcaagagcgatggcggatcgtaacgggttatcaagaactgaattgggaaaaccggagatggatgtcgtggcggagctggtgggggaagacaaagattgtcctattgaaggattaacttcatggttgagtcgtccttcgtatgttgccatcaagaaattcttgtcttccatgcatcgctgaaccttctttttgacagggcatgcgggagccattgaacacctaaaataagctcggggaaaaggattatgtttagtaactttctggccatatttcctccattgaaatccatctttaactatatggctctagtgcctagggtcagtttccacaaaaacttgtgaggaatttgctgctaactgaagttgaggtattagaatatttttgtgggagtgctgatcttcgcacatatcacatcgcgttaagcctaggcagatatgtgtacctcggccgcgaccacgcttagggcgaattctgcagatatncatcacat

SEQ ID NO: 15810 - DNA, 410 bp, Gossypium hirsutum
  Predicted polypeptide sequence is orthologous to G896
cgcaatgcgttccaacattcgtcatgtgccttagagcggatttgttacctctcttctcacaatgctcttaacaggcggcagcctcggtggcagatcaagaccggagccacagttaacagccaccgagccatttgatgtgtataataaacctttttccttgtaattggtaaacatgtgcgcggcatgcttttcattcttttgacgaagcctaagcccgagctttgtacagtttttgagggacaaaaagaaaaaggaaataaattcatcttctatttatcataaataattttattatttaggcgaatgttgatgcgactgacactgacatgaatgtgttggacacggttattggacataaatcttttaaagaaaataaagagcacggttaattttaaagtcgacgcggccgc

SEQ ID NO: 15811 - DNA, 949 bp, Gossypium hirsutum
  Predicted polypeptide sequence is orthologous to G896
ctttcaacatcatcaacacccatgttaatgcaggtcaactgttctaattgccacgcgccactgcacctcccgccggctgcaaactccatatgctgcgtcctctgccaagctatcaccctcatagctgaccctcgctccctacccctacctcttccctcttcctcccaccaacaacaacctcttccatctccttacaaccacgcgccgcccggtcccccaccgcaggctcatggccgcaagcgcgctgttatttgcggcgtgtcttacaaaaacacccagtatgaacttaatggttgtattaacgatgccaactgcatgaagttcttgttggtgaatcgcttcatgtttcccgagtcctccattattatgcttacggaagaagaaactgatccttacaagcgtccaacgaaacgcaacataagaatggcattgcgttggcttgtccaaggttgtcagcctggagattccttagtgttccactactctggtcatggctcgcagcaaaaggacgacaatggagatgaggtggacggatacgacgagaccctttgtccattggacttcgagtctcagggaacgatcatagatgatgaaatcaatgcaaccatcgtcaggcctctaccttgcggtgttaagcttcacgcaatcattgacgcttgccatagtggcaccgtattagatttaccatacctctgtaaaatggacaggaaggggagatacgtctgggaggatcaccgtcctcggagcggaatgtggaaaggaacaaatggtggggaagtcatttccttcagtggctgtgccgatgatcaaacctccgcagacacttcagccttatctaagattacttccaccggtgcaatgacttactccttcatccaagctattgaatatgggcatgcgaccacttacggtaacatgctaaacgcaatgcgttccaacattcgtcatg

SEQ ID NO: 15812 - DNA, 933 bp, Gossypium hirsutum
  Predicted polypeptide sequence is orthologous to G896
gaataatgtatccgccgccagggccaggaggcatgtactacaattacccgccgcctatgctggtcaactgctccggctgccacacccctttgcagcttccgcaaggtgcccgatccatccgttgtgccatctgtaaagccgttaccaacatcgctgaccctcgatccctccctcccgcgtcccaatcacctgctccttccacccacgcgcttccttctccctccccttacaatcatgctcctcccggggcacctccccacgcccacggtcgaaaaagggcggtggtctgtgggatttcgtatagatactcgaggcatgagctcaaaggttgcatcaatgacgccaagtgcatgcgttaccttctcgtcaacaagtttaagtttcccgaggattccattcttatgctcacagaagaagaaactgatccctacaggcttccaacgaagcataatataaggatggcattattttggttagtacaaggttgtcaacctggtgattctctgttatttcactattccggtcatggttcacggcaacgaaattacactggtgatgaagttgacggctacgatgagactctttgccctttggattttgaaactcaagggatgattgttgatgacgagatcaatgcaactattgttcgacctctacctcatggtgttaggcttcatgcgattattgatgcttgccatagtggaactgtattggatttaccattcctttgtagaatgaatagggctggacagtatgtatgggaggaccatcgtcctgcatcacgtttgtggaagggaacaagtggtggagaagtgatctcctttagtggttgtgatgatgatcaaacctctgctgatacatctgccctatcaaggattacatctaccggtgccatgacattctgcttaatccaagccatcgaaagggggcatg

SEQ ID NO: 15813 - DNA, 707 bp, Gossypium hirsutum
  Predicted polypeptide sequence is orthologous to G898
gatttttccaattcctttttggtagaattttttatttctcgattcgatttcgtctgtgcttcttggtttattgagactgcagtccttggatggtacattgagaaatcataagcagagcatgagcactcttgagataagggggccttctcttaggggatatcgaaggagaaaggcagtgcttgatctgaatgctccacccagtgaaatcagggagcaggagggtacatctcaacaggctgggtatgaggatcaaacgaatcaatctgtacagtctggtccacctgcaaccattgatgttgaggctattgatgatgatgtaattgaatcttctgctagagcttttgcagaggctcagaacaattctaggaggagccgtggaaggactgtggttgatgttgattcagctcacatttctgcccttccaggctggtcagcgaggtcaagtaataacaatcagaatatgcacagaagacttcctccgagctcaagcattattaatttggaaatctcgccacagtcaattcaggttgaggaaatcacaaagccacagccacctccaaaggaaccaaccttcaattgtccaatttgcatgggtccattaacagaggagatgtcaacaagaatgtgggcatattttctgcaaggcatgcattaaactgcaataactacacaggcaaaatgcccaacttgcaggaaaagagtcacag

SEQ ID NO: 15814 - DNA, 843 bp, Gossypium hirsutum
  Predicted polypeptide sequence is orthologous to G904
cttcctttacccccccaaatacaattctgttccttacacgtcatcctcctccacttgtgatacagtaaggaccaagaacccatcaatggcgtcgccgccacctttgttatacggagttattggaggtcctgtggcctcctcggaaaataatagcagtgaacgctcccattcttcttcttcttcaattgagagtgcaaagccgagtattataataatcattttgatcctttctataaccttgcttgtttctgtttctctttgtctcctcttgcgtcatctcaaccgccgttgcttgcgtcacctctctcgttcctctacctccactattgtcgcctccgctgccagccaccgtgtcagtcccgaacaatcaccgacggctttgttgcttgattctcttcctctttttactttctcttccattactcgccgccgctccaacggtgattcaacggtttccggagattgtgccgtttgtttgtcgaaatttgaacagcaggatcagctcaggcttctccctatctgttgtcacgcatttcacgcccagtgcattgatacttggcttacttcaaatcagacttgtcctctatgccgctctcctctcttcgcttccgagtccgatctcatgaagtcgttgcttcagtcttctaacgcagccgcaccgatcggaagtggcggaagcgatagtttccggcttgagatcggttctgtaagtctccggcaaccaggctcagaatcaggtgagcaaagaacgtcgtattccattggctcttttgattatatcgtcgaggaagaatcagaggtgactaggaatcaaactcatcagagaaacgtctccgataaaga

SEQ ID NO: 15815 - DNA, 905 bp, Gossypium hirsutum
  Predicted polypeptide sequence is orthologous to G912, G2107, G2513
ctcaacaacttcatatacatataaacccctttcatttcacacttcaaattcataaacttatcttttattttacaactttgggtttgattttattctactgggagtgaaagttcaatgtcaagctccttgttcaaatgctaaaagtcaaatatttgtttaattgaaagttgaattcacggttttattccttgttatggattctttgagtttagattatgggtcggtttcgtcaccgatgtcagatagtgggagtggaaatggagcttctcgtccgccgaatttttccgatgaagacgtgatgttagcttcgtgttaccccaagaagcgagcgggaaggaagaaattccgggagactcgacacccggtgttccgaggagttcgccggaggaactccggaaaatgggtttgtgaagtaagggaaccttacaaaaagtcaaggatttggctcgggacttttccgacagaagagatggcggcgcgtgcccacgacgtggcggcgttagctctgagaggaaggttggcttgtttgaacttcgcggactctgcttggagactccctgtaccagcttctaccgatccaaaagacatccagaaagcggcggcggaggcagcggaagttttccgacctgttgattccgccggagatagctcaaagacagctgaaaacacggcggtggagggaactaaagagtcggaagaagtgttttttttggacgaagaagcagtgtttgggagagaaaagtttttggcaaacatggcggcggggatgatgatgtctccgcctcacagtggatatgaaaaagatgaacaagaacttgagtttgtcgatgattgtgtgcagctgtggagctattctatttaaaagtataaatatatcagactcaatagaatttgatcaatccttt

SEQ ID NO: 15816 - DNA, 928 bp, Gossypium hirsutum
  Predicted polypeptide sequence is orthologous to G912, G2107, G2513
tccaaatccaaaaccaaaagattcaactcccaaaaccgaacccagacaccataatctcgaaaccgttttgaaaagtactttactgctccttttgctgcttaaaaacccaacacccataacttgttttttactcaattcaatggatattccaagtcaaacgtgtgacgtccccttctccaagtcttattctatgcgtgctgaaagggtagagccatcttcatcttctgaagggggcattggtggccagcgagctgttcactctgacgaggaagtgcttttactagcgaccaacaggcctaagaaacgagcagggaggagggtattcaaggagacgcggcatccggtttttagaggtgttcgaaggaggaataatgataaatgggtatgcgaattgcgggagcctaataaaaagactcgcatttggcttggaacgtatcccacccctgaaatggctgcccgggcacatgatgtagctgcattagcattcagaggcaaggctgcttgccttaacttcgctgactctgtttggaggttacccgtgcctgcttccaacgatgccgccgatatcaggagagccgcagctgaggcagctgaagcatttaggcctcaagtattccaggaactctccggtagcgacgtcaggcagggaagcttcaaggcttccgattgtgaagtttcgagcagtgacgtcaagttggaaaacaagaaaaaaatggcagctgaaggtgaagtttcgacagagaaaattcacttcatggatgaagaagaaatgttctacatgcctaagctgcttgacagcatggctgaagcgcttctactttcaccaccaaggaatcgcgatgaagctgacagtgatatcgatgtgtctttatggagttactcaatctgaagtgtacaaactacaaactactgcaagtgtttgttttgt

SEQ ID NO: 15817 - DNA, 1102 bp, Gossypium hirsutum
  Predicted polypeptide sequence is orthologous to G912, G2107, G2513
ggccattacggccggggagaaaaagaaagctcatttagttaatattttcccttgcatttccaaattcggaagttcatacagcaagtgatttcctaaaatacttggatcctaagtacgaatatccttttcttgaaatatactctttttaagtcaaaagctttgtttaactgaaacttaaactgattactgtttgggttttttttttaaatggattttgtagttcaagattatgatatggttgattctgggtcggtttctgaaagtggaactgatcgtccggtgaatttttccgatgaatatgtgatgttagcttcgagttatccaaagaggcccgcgggaaggaagaagttccgggagactcgacacccggtgtaccgtggagttcgccggaggaatcccgggaagtgggtttctgaagtgagggagcctaataagaagtcgaggatttggcttggaactttcccgaaggcggatatggcggcgcgtgctcacgacgtggcagctatagcactgagagggaagtcagcttgtttgaacttcgctgactcagcttggaagcttccggtcccggcttcttccgacccaaaggatatccaaaagacggtggcggaggtggcggagactttcagaacggctgagcattcgagcgggaattctagaaacgatgcaaagagaagtgaaaacacggagatggagaaagggttttacttggacgaagaagcgttgtttgggacacaaagattttgggcaaatatggctgccggtatgatgatgtcacctcctcgttccggtcatgacggaggatgggaggaacatgaagtcgatgattatgtacctttatggagttattctatttaaaagtaaaatttttcagacattttcaagcattcattggaatttttagttcacagaaatcgccaccggcaattgccctttatgttttgtacgtacaacgatttttttggattgtacgggtagtgctgtaagtaaaaagattaatgtgtatatatacgatgtatatatacttcatagcttctccaaacaataaatttatagcttcatatctattttaccatcaaaaaaaaaaaaaaaaaaaaaaaaa

SEQ ID NO: 15818 - DNA, 647 bp, Gossypium hirsutum
  Predicted polypeptide sequence is orthologous to G913, G976, G1753, G2514
ttttttttttttttttttaagagataactttaaacttggaatataaataataaaataaatatgaaaaataaaacaaatagaatgatgtataccactgagtctaacctaatccaaatcatatactatggatttaaaagtaatatgaggttgatgtaaatcctaaccttgtatgactagttggttaattggtatactttttctactattttttttaacagaaactggaaaaatgaagcgaaaacaaagaaaatagaaaaaaacacaacatagcaaaagcaggcttataatttagtaatgtccccataaatcaatgttaaaggtggaagctacgttatcgtcgcaatcataaacttgtgcctgcaaagcagcaggtgaagagaggagcaaaccttcagccatgctatcgattaagcctggcatgttaaacaatgcctcctcgtccatgaaaccataattccactcattatcattaatgttggtggtctccaagctccaactacgatccaacatcgagccataatctaaaacgctcttttcttcgtcgttctcagtggaaactgaggttgatgatgagcatcccactggttgaggatcaatatccgttgaagttactggtttaaaagcctcggcagcggcaaacgcagcga

SEQ ID NO: 15819 - DNA, 876 bp, Gossypium hirsutum
  Predicted polypeptide sequence is orthologous to G913, G976, G1753, G2514
cacaaacatgactgaatctgattcttcttcaaccaatgtgcccccaaaagaccagccgccaccaccaactgttcccatccctgacgctccgccgcaagagcagtcgccgaaaccatcatctactccattgatctcatcgaaagaaggcgtaagtgggaattccacatcgagaaagttgccggcggtttatcgaggagtaagaagcaggagtgggaaatgggtgtcggaaatacgtgagccgcgtaaaacgacgcgtatatggctagggacataccctacacctgaaatggcagccaccgcgtatgacgtggctgctcttgccctaaaaggtcccgacgcggaactgaactttccggatatggttcattcgtatccgaaagtgggttctacatcggcaactgatattcgtgccgccgctgctagtgccgccgcttctagactactacccaaggctgtaaccaacactgggtcatcatcaaaaaacgaggacaccacatcgactactgctatggagattacatgttcaggtcaagaatttatcgacgaggaagagcttttaaactttcccaatttgatggtggatatggcagggggaatgctagtaagccctccaaactggataaactcaccaccttctgatgattcaccagataattcagatgtagatacactatggacttacacttaaaatagaaaaattcactgtaaaagtgatgaatgagagagagtatacagtacaatgaaatgtagaagaagaagaagcatggtttaaaaactagggtctagatgcttctgatgattcagtaatatgaaatgcagaaggtactgtcatttgtcctctttttttaactctgtctcttctggtttttatctctt

SEQ ID NO: 15820 - DNA, 586 bp, Gossypium hirsutum
  misc_feature (451)..(451): n is a, c, g, or t
  misc_feature (457)..(457): n is a, c, g, or t
  misc_feature (492)..(492): n is a, c, g, or t
  Predicted polypeptide sequence is orthologous to G916
aaacatgtgaagggaaggggtctcccatgcaaagcaaccttgacgataatgatgatggccatggttcttttactcggtcagcaggcatcagcattttcagccacaaccagcaacaacaacaatagcagcaacttggctacccattgcggtgcctctaccatggaggaatgcttggtggacatcggccatgcagatcatgtgttcttcgctgagccagagacgagcctgcagaaagatccacctaaattcatcgatgtttctaagaacaacttgattactccaaatgataaatgtgggagaccaagatcaggtcagccctataatccttgcgtcccagactctaatgatagcaaaaaaggtaacactgtacggcaatttacaaagacaacaatagaaatcgcggatgcaagtagaattatcttgccgactatggattttttctagctactgnttatgnaaactaaataaagattgcattctaatttgcttagnttatacaagctaaattttgctattaatttttgtacttttggcgaaaattgcgaatttaatctttttactttaattaaaaaaaaaaaaaaaaaaa

SEQ ID NO: 15821 - DNA, 675 bp, Gossypium hirsutum
  Predicted polypeptide sequence is orthologous to G921
tttttttttttttttttttttttttttagctaagcagcgtgccgccgttcatatttgcaccaaagcatatacaaagtacaaaagtgtttgatattcactccattatctatcttctctctttttcaccaaaaaaaaaaaattaccatagtgttttagtttgtttttgaagttcacgggggtgatggtttagggtgttcagttttgatggagcgagcaaccgctgcagctaaagctagagtgaagttaggatcttttgttaaggatgcaacatagtcttcgatcttcttcttcttattatttccgtcgtcgttactggtgctataatcatgcataaagcttggaaggtttctgtggttttgtaagtcggagcctgaaagagtgagatcaagggtgatgggtggtggaaaagggttatccagaggtggaaaaggaatgcttctcgtcccggaaaatatcgccgagctgcatgatgctaacattgattttccggcagctgtggaatcaacatcatggttgtgttgtccttcgtatgttgccacaacaatagatttgtcctccacgcatcgctgaaccttctttttgacagggcattccggagccataaagcacttaaaataagctcgaggcgagggattatcttttgtaactttctggccatattttctccattgaaat

SEQ ID NO: 15822 - DNA, 556 bp, Gossypium hirsutum
  Predicted polypeptide sequence is orthologous to G921
ttttttttttttttgcgttaaaacgtattttcttttatttataagttaggaagggaatgtgaatttacagaccaatttattcaaaaacaaaaacaaaatgaaaagaatatttacatgaagctgatgcttgaacagatttcctgtcctattctgtttttaaattgtgtgtttccccaattcttctgcaatgtcgtatttacaacattctaagttcataacaattactacttatagttgacaaaatcatagaaacaactctttgtccgccggtatattttcccagcaagacagatataaatcctaaaatagaaacgagaaaaaaaaaactctaaattgatcttatattttgagatattaattccatcccattttttttattcaactggactttgctgaaacattcttcctgaaatggcagctgccaatgctgctgtgaattttgggtctttcgtcaaagaagtagccatctgttccaccaaatattgtctgacttgcggtgaatccatttttggcagaccggagctgcagattctagctacatcactaccactgggct

SEQ ID NO: 15823 - DNA, 949 bp, Gossypium hirsutum
  Predicted polypeptide sequence is orthologous to G921
atgaatatattagatctggatctttgcttaaagattgaaaaaaaagctatgaattcttcttcgtcttcatgggttgattcgttggatcttaatgcttcttcaacaaagtcccttcaacttgaaactcctgtaagtcatcccaataccagcaacagcttaattgtatttggaaggaaactttcagtcaaagaagagagtggtgctttaatggaggaactgaaccgtgtaaatgcagaaaataagaagctaactgagatgttaaaagcaatgtgtgagagctataatgcattgcaaagccagttagtggatttgatgaacaagaatactgagaaagaacttagtcctacaaagaaaagaaaatcagaaaccagcaacaacaacaatgggaatatcattgggaattcagagagtagttcaactgatgaagaagaatcatgtaagaaacctagagaagaaatcatcaaagccaaaatttcaagagcttatgtcaggactgaactatctgataccagccttgtggtaaaggatggatatcaatggaggaaatatgggcaaaaagtcaccagggataatccctgtccaagagcttatttcaagtgttcttttgcaccaagttgccctgttaaaaagaaggtgcaaagaagtgttgatgatcaatcagttctagttgcaacatatgaaggtgaacataatcatcttcccccttctcaaatcgaggcaacatcgggttcgagccgccttggttcggtccctgttggttcgaccccagttaagtcatccggtccaaccattactctagacctcaccaattcaatcaagtcaagtgatgaagctagaaactcaaagccaaaactagattcaccagaagctacgcaatatttggtggaacatatggcatcttctttaactaaagaccctaatttcactgcagcactggcagctgctattt

SEQ ID NO: 15824 - DNA, 961 bp, Gossypium hirsutum
  Predicted polypeptide sequence is orthologous to G921
cagtaatggaaccagcttgggtggatactactttggatctcaacatcaacccttgttttcgcaccaacaaagctatgaaacgagaatttgagggagatgtggctgagtcggcaccagttaaatatgagagtggagtgttggtggaggaattgaatcgggtcagcgccgagaacaagaagctaactgagatgctaacagttctatgcgaacagtattactctttgcagcaccaattcatggaattggtcaacaagaaccctgaaattgaaactactgctgctgcaacaacatcatcatcaaagaagagaaaagctgagtgggaggattatggtgccaacatgattggatttagtgggaacactgagaccagctctagtgatgatggctcacctaaaactcccaaggactgcattaaacctaaggtttctagggttcaagtccgcacaaatccttctgataatagcctgatagtaagggatggatatcaatggcgaaaatatggtcaaaaagtcacaagagataacccctgtcccagagcatacttcaagtgctcttttgccccaagttgtccggtcaagaaaaaggtgcaaagaagtgctgaagacccatcgatcttggtggcaacatatgaaggagagcacaaccaccatgagcaccaccgttctccacctgctgaaatatcattaaactccaacaacaacacccctagttccaacactggttcgggtcctgtttcatctgccccaaccaaagctttagcttccactgtaacactagagctgcttcaaccagctggtttgggcggcgatgaaaccgaaagggcagccctacaaatcgacgcaccagcaatccaacagatttagtcatcaaatggcggcttcttgagcagagacccatttcacggcagccctgctgcagcattcaggagagctgtgtagacggaaatagatgaaagtggtga

SEQ ID NO: 15825 - DNA, 550 bp, Gossypium hirsutum
  misc_feature (42)..(42): n is a, c, g, or t
  misc_feature (88)..(88): n is a, c, g, or t
  misc_feature (148)..(148): n is a, c, g, or t
  misc_feature (153)..(153): n is a, c, g, or t
  misc_feature (155)..(155): n is a, c, g, or t
  misc_feature (157)..(157): n is a, c, g, or t
  misc_feature (181)..(181): n is a, c, g, or t
  misc_feature (199)..(199): n is a, c, g, or t
  misc_feature (214)..(214): n is a, c, g, or t
  misc_feature (282)..(282): n is a, c, g, or t
  misc_feature (291)..(291): n is a, c, g, or t
  misc_feature (321)..(321): n is a, c, g, or t
  misc_feature (324)..(324): n is a, c, g, or t
  misc_feature (520)..(520): n is a, c, g, or t
  misc_feature (547)..(547): n is a, c, g, or t
  Predicted polypeptide sequence is orthologous to G922
tttttttttttttttttttttttctcaagctgccatcatgtnctcattaattgcttcctttgcaactcaaactccaacagcagcccanggaaatgaatgagatacatgtttaaaattttttctcaagtaactatagaatgaaaaagtntttcntntncatacaaattaaactacaatcaanggaagaaagaaagagacncctaggaggagggtncagggcaggcataaataaaatgagtcgtaatcctagcgtctaaacccccaggctgatattgaatatanaggtctttnttgccagcacataaccaaacacccattctnttntttcatcttataaccatcgtagttattggtctgcagcaaccttcctgcctgcaacatgccatggtagcttaatggcacccttccaaacccggccaattcaagtctcaggatccatttctccagcttttcatgtctctcctttctctcaccaccctcacatgctataatattcttaatttcctctccgaaaagcatnttctcaaccttttgtcgctctattggngct

SEQ ID NO: 15826 - DNA, 921 bp, Gossypium hirsutum
  Predicted polypeptide sequence is orthologous to G926, G2632
cccgggagtgagaggagtgaactcattaaattcatcttcgatggaatgcactaatgcatcagagtcgaatgatgggcagtcactgtccaatggtgcactaaatgaagaggatgatgttaataaagaaacacaaactactgcatcctctcgggcagttggaactggaggacaagaacatcacaatttgcagcatgttggatctagcatgcctgctgtgcgtgatgaaggcctcacccaacctcccctgcttgagcttgttggtcattcaatcgcatgtgcatcaaatccttatatagatccactttatggaggaatgatggcagcttatggacatcagcctatgggttatcctccgtttgttggaatgcctcatgcaagaatgactttgccgattgaaatggcacaagagcctgtttatgtaaatgccaaacagtaccaaggaattctcaggcgaaggcaggcccgtgccaaagcagaacttgagaagaaggttgttaaatcccgaaagccttatcttcacgaatcaaggcaccagcatgctttacgtagggcgagaggtagtggaggacgttttgcaaagaaaacagataccaatccaggagaagaaaaaggatcaggttcaggtcccacgttatcatcccaatctccaagttcctccggttctgaaccattacaaactgattccaacgaaacctggacctcctccctcacccagcatggcatccaccatgtcaacggcggcagccattatcagaagctaggtggtaacatctccaatcacgccgctttctatccggtgaatggaggacaatcctttcaaagctgatggttgactccagagacgttacagtcatggcatgcattagcgagcggcaatcattcttggctcgtatatggaagggagaagagattgtacgagac

SEQ ID NO: 15827 - DNA, 814 bp, Gossypium hirsutum
  Predicted polypeptide sequence is orthologous to G926, G2632
taaaaacctcttattaaaattttaaacatataaataaagataatttattaagcttgatagatttgtctttctctatgtctctgttatggttgcagagagagagccaaactgaatcaatctctaggcatttgcttctccaattccaatcttctttttctttttcttcttttactaataagtcgtgagaaatgccagcaaaaccagggaatgatgatcagcagatagaccatggggctcaaagtgtgttgcagtcaactgcctactctgaaccctggtggaaaggagttgggactaacccctttgttgaagctgcctcgaagtcgccttctgtagaacaactaaatggttcagtggcaaatggagctgtgcattcacaggctcatggggacttgggcaatgaagatgggagaaacggacaagatcgccaacatctcaaacacgttccttccacaacaccccttactttgggtgaacaccatgaaccaaattcccaaatggaactagttggtcactcgattgtcttgacatcatatccttattcagatcctcagtattgtggaatgctgacttcatatgggccacaaatgatggtgtcaccacatctatatggaatgcatcatgctagaatgcctttgcctcttaaaatggaagaggagcctgtttatgtaaatgcaaagcaatatcatggcattttgaggcgaagacagatacgtgctaaggctgagcttgaaaagaaagccattaaagttagaaagccataccttcatgagtcccggcatctacatgctatgagaagggctaggggttgtggagg

SEQ ID NO: 15828 - DNA, 372 bp, Gossypium hirsutum
  Predicted polypeptide sequence is orthologous to G927, G1334
gcttagcgtggtcgcggccgaggtactctacaagctgggagagtcactgaacaaggactgaacaaagggaatcctgctcacttcactatattccctggtgatggcaaatgttcaggggatggacaaaaatctccgaccgtcatatctctgcaatcagttccatcagaacagcattctcgctttgaactaggatgtggtcagccgcccatggtctgtgcaaaatatccttacatggatcaatgctatggagttttctcaacttatggacctccagtttcgggtcgtgttatgctgccattaaacatagcatcagaggatggaccgatatatgtaaatgccaagcagtacctgcccgggcggccgctcgaaagc

SEQ ID NO: 15829 - DNA, 856 bp, Gossypium hirsutum
  Predicted polypeptide sequence is orthologous to G928, G931
gtccactcacgcgtccgaacggaactcatgggaagcttgtaggaaatcatgctaaattagcctatgtaacgggaactcaggaccatgtctttcctccttcacaaggttatagaaaaccaatcgttcacattccacaccattatgccaacccatactttggcagtgtagcggctactgcttatggatcacaagctatgattcatcatgctcatatgatggctatgcttcctgctcgagttccgctgccactggatcttaaagaaggtgaaccgatttatgttaatgcaaagcagtatcatgctattctccggcgaagacaatatcgtgcaaagctcgaggcacagaacaaactcataaaagttcgaaagccgtatatgcatgagtctcgacatcttcatgcgataaaacgagctagaggaagtggtgggcaatttctcaacacaaagaaactccaatccaaaagcactccgacaagccacggaccggacatgtccaggtctcctcagctgcatttgtctgcaaacatctctgtaacagatgttcatcagccagaaaatttcaaagattctggttcagctaactcttgctctgatgtcacaagtgcctccaacagtgatgaaatatttcagcagccagatttcaggttctatagctatccttccggtcatactggtgaagccatgccgggtcatgctggtcatatcctgctctcttccgatagtcgagcgaactgattcttgtccacgcagtctgtattcgatgatgctgcaatgaaaatacggctgctctgttcctctggggagtcatccttggctctgtttattatatttggactgtcatcacagattgttacaaa

SEQ ID NO: 15830 - DNA, 344 bp, Gossypium hirsutum
  Predicted polypeptide sequence is orthologous to G937
accttgttttgggtggtggtcatgcatgaatgtgtcaagatcagtttggagaatcctcgaaagggagcagttcgcagtcgggtgcccttaagggcctctccagttagccacaaacaccggagggacctccactacatggtgtgagagcatggaagatgatgaagatgcaaaatccgagtgctatagttggaaaagccatgttcaaaaacccataaaaaacaatatatagagtttacccaccatgaattttgcagataaaaaaaaaaaagaaagaatgtattatgaggaaatcatttatctggagaaattttcatttctgaaaaaaaaaaaaaaaaaaaaaaaaa

SEQ ID NO: 15831 - DNA, 609 bp, Gossypium hirsutum
  Predicted polypeptide sequence is orthologous to G938
ggtgttgaagatgagccgaacttcgatgtgcaagagcgcaaacccaggactatcagttctaatatggtcatggagagaatgagggctatccaacaaccaccttattcgattaagggggaagttgttggtaatttggatttcacgcgaaagaggaaaccatccaatgatttaaacatggttgaacaaaaaatctacacttgtgagttcctccagtgcccttacagtgaatttcgtttgggttttcatgataggactgccagggacaatcatcaattgacttgtccatatagaaattcctctgcacagtttggtggttcgaatttcagtgttaatgaagtaaaaccagttattttccctcggcaattcggacaatccaagccagctgcaccgcaggttacatctgtctcaacaccctttgatctatccggacttggagttccagaagacgggcagaaaacgatcggcgaactcatgtcagtatatgataacaacattcaaggcaacaagaacatgaatcctagtaacaatcttgttaccaaaggtcaaaacgttcttcagccgaaaatacaacatcagcaagatgaattcttccgcggtcaaggagtcatt

SEQ ID NO: 15832 - DNA, 898 bp, Gossypium hirsutum
  Predicted polypeptide sequence is orthologous to G938
caacaggggaagcaagctaaagcagccaccccccttcccctttttctccaattattatctttattcatccattattctctctctgtgtctatgcttttgttcttctcatagtcttcttagtgttgcctaaatggcgtctttgagcttctttttcccttctggttaatggagtcctttggttattggatgatttgaggttatatcagttctaagttgtaacagatactagtagaaactcaaagcttcagtttgatttcggagatttcctcgagtttcggatttgttctgagtcctgtattggaacgatgatgatgtttgaggagatggggatttgtggggatatggatttctttggtgcttctttcggggaaaaggatgtgacggctgcttcacaggtcgaaatggatgcactagttgatgacgattatagtgatgaagaggtcgatgttgatgaacttgagaggagggtgtggagggacaaaatgcgattgaaacggcttaaagatcagagtaagggaaaggacggggttgatacagccaaacaacgccagtcgcaagaacaagcaaggaggaagaagatgtcgagggcgcaagatgggatattgaagtacatgttgaagatgatggaagtgtgtaaggctcaaggttttgtatatgggattattccggaaaagggaaagccggtaactggggcatcagacaaccttcgagaatggtggaaggataaagtgaggtttgatcgtaatggtcctgctgctattgcgaagtaccaggcggataattcgattcccgggaacaatgatgggtgtaacttgatcggtcctacaccgcacactttacaagaacttcaagatacaactcttggttctcttttatctgcactgatgcaacactgcga

SEQ ID NO: 15833 - DNA, 843 bp, Gossypium hirsutum
  Predicted polypeptide sequence is orthologous to G938
ccctctctctctctctctctctctctctctctctctctctgtctgaaaatcttctgtttgttgctgaatttacttctttcagctttttggaataaacccaaactgtgggtttttcctggcttatcttggaacaatgatgatgtttgatgatatgggaatttgtggggatatggatttcttcagtgctccttttggggaaaaagatgcggccacggcaacgttggcggctttgcgtactgaaccagaggccacagtggaagatgattatagtgatgaagagattgatgtggatgaacttgagagaaggatgtggagggacaaaatgcgtctcaaacgacttaaagaacagaacaagagcaaggatggggtcgatattgtgaaacagagacagtctcaagaacaggcgaggaaaaagaagatgtcgagggcgcaagatgggatattgaagtacatgttgaagatgatggaagtgtgcaaggctcaaggttttgtttacggaataatcccggagaaaggaaagccggtaactggggcatctgataatcttcgggaatggtggaaggataaagtcaggtttgatcgtaatggtcctgccgctattgccaagtaccaggctaataattcgattcccggcaacaatgatgggtgtaacccaattggtccaataccacacaccttgcaagaacttcaagatacaacgctcggttcccttttgtctgcactgatgcagcattgtgatcctcctcagaggcggtttcctttagagaaaggtgttcacccaccgtggtggcctactggtaacgaggaatggtggccgcatctcggattgcctaaagatcaagg

SEQ ID NO: 15834 - DNA, 943 bp, Gossypium hirsutum
  Predicted polypeptide sequence is orthologous to G938
caaggttttgtttacgggattattccggaaaagggaaagccggtaactggagcatctgacaatcttcgagaatggtggaaggataaagtccggtttgatcgtaatggtcctgctgctattgctaagtaccaggctgataatttgattcctggcaagaatgatggctgtaacaacattgggccaacgccacacaccttacaagaactccaagatacaactcttggttctcttttgtctgcactgatgcaacattgtgatccccctcagaggcggtttcctttggagaaaggtgttcccccaccatggtggcctactggcaacgaggaatggtggccacaactgggattgcccaaagatcaaggtcctcctccttataagaaacctcatgacttgaagaaggcatggaaagtgggggttctcacggcagtaatcaagcatatgtctcctgatattgccaagattcgcaagcttgtaaggcagtctaagtgcttgcaggacaagatgacagcaaaggagagtgcaacttggctcgctatcattaaccaggaggaggccttggcacgagagctttaccctgattcctgcccacctttgtcctcaggtggaggaagtgggtcttttgttataaatgactgcaatgagtatgatgttgaaggggctgaagatgagccaaactttgatgtacaagagctcaaacccgggcatctcaatacatctaatttcagcatggatacaatgagggctgtccaacaacaatcgtatcctattaagggagttgtcaataatttggatttcatgcgaaagaggaagccatccgatgatttgaacatgatggaacacaagatctacacttgtgagtcctccagtgcccttatagtgactccgcctgggtttcgtgacagactgccaggacatcatcattacttgtctttcagaactcttc

SEQ ID NO: 15835 - DNA, 519 bp, Gossypium hirsutum
  Predicted polypeptide sequence is orthologous to G938
tttcttcagatgctccacttgtgggaaaaagatgtggcagcctcacaaattgaaccagaggcgagggtggaggatgattatagtgatgaagaaattgatgtggatgaacttgagaggaggatatggagggacaaaatgcgtctcaaacggcttaaagagcagaataagtgcaaggaggggattgatattgctaaacagcgcctgtcacaagaacaggcgaggagaaagatgtgggggttctcacggcagaataagtgcaaggaggggattgatattgctaaacagcgccgatcacaagaacaggcgaggagaaagaagatgtgggggttcacacggctgtgatcaagcatatatgctcgttttctttagttttggaatgggtcagaagatttctttctgaccattttcaaattttttgatgttgtaaaactatataacatatggattatgatgtagaatttaattttaaccttttcttaatataagataattatgtttatgtaaaaaacaaaaaaaaaa

SEQ ID NO: 15836 - DNA, 868 bp, Gossypium hirsutum
  Predicted polypeptide sequence is orthologous to G987
cggttttcatctcattctcaaaatggtagtgctaataatgggaatggattcatgggatgtcctgcgagtgagtttttagttccaaattattttagtcaaagtgaattagcattgcacttcaagagggggtttgaggaagctagtaagttcctaccaaaagctaatcaactgaatgtcggtttcaagagcaatgcattgatttcagagttgaagcagaaggcttcaaacacggtagtcaaagtggagagtgacaggaaggagtgctcaccacctcgtttgatgagaaagaagagtcatgaacgagaagatgaagatttagaagagaggaataacaaacagtcggcagttttgggggacgagagcgagctatcagacatgttcgataaggtgttgatttgtgctaggagaagagggcagtcttcttcatccactgcggatgagactttgccgaatggaccaagcaagacgctgctgccgaatgagcaaacaaatggatccaatagtgggaaggcgcgtggcaagaaacagggtaagaagaaagtagtggatttgaggactctcctgatcttatgcgcgcaagctatcacttccaatgacaatgtgactgctaaggaactgataaagcagattaggcagcattcttcgccctatggtgacgggtctcagagattagctcattactttgttgacgcccttgaagcacgcttagctggcactggaactcaaatttatacctctctggttgctaaaagaatgtcagccgctgatatgttgaaagcttaccaagtttatatttcagtctgcccattcgtgaagtgcctattatttttgcaaacaactacatttcgaagcagcagagaaagcaaca

SEQ ID NO: 15837 - DNA, 870 bp, Gossypium hirsutum
  Predicted polypeptide sequence is orthologous to G987
ctttgactactcttcttcaccaccttctgggtttcctttcttctttgtttcatatatcatttctgggtgtccttcaattccttcatttttatcactctttcaataacccctttctcagccaattaagtttccatggatactacccttttccaagattttcccagttccatgtatgggttcaaactcgatcatggagcagtaccagtatattcaattcacgacttcgtcagtaataataatgggtttattaaagatagtcctccacaggttgttccgagtccagactcacctgttgagtcagggacaacaacgaattcagaggcacatccccttgacagcatcccttttgccaatgagatgctcaagtacataaatgagatgttaatggaagaagacatggaagaaaagacctgtatgttgcaggattgcttagctctccaagccgctgaaaaatcattctatgaagtccttggccatgaatatccactttcaacggatcccatccctgcatatacagatcaaaatggtggtagtccaggtgatttcaactcctctttgatccaaacatctcttgttgatactcttgaaaggacctctttgttcccagatttacaaagagggatccccccatcaatagagccttctggcagcagcttattagggtcaaagggaaggaaaaattatgaacgaggagatgttgatgacttggaacaaggtaggagcaacaagcaatttgctgtttcccttgaagattcagagcaaacagatatgtttgatgatgtactgctttgcaaaggtgaaaacgaggatgatccaaggtgttctcttaataagagttcgcaacatgtttggccgcagaaagggacatcc

SEQ ID NO: 15838 - DNA, 863 bp, Gossypium hirsutum
  Predicted polypeptide sequence is orthologous to G987
caaggtgttctcttaataagagttcgcaacatgtttggccgcagaaagggacatccaaaggtggaacagcacgcaggaagaacggcaagaaaagtgaggtggtcgatctgtggagtctcctcactcaatgtgcacaagctgtcgccattaatgaccaaaggaccgcaaatgagctgttgaaacaaataagtcaaaactcttctacaactggagacggaacccaaagatttgctcattactttgcagatgcacttacgacacgtttggctgggatgggggcaccatcgtattcaccattggtaagcaataggacgtcagctgctgatatcttaaaagcttacagagttcttgttttagcttgcccttttaagaaaatgatgcatttctacgcgaataagaagataatgaaggttgcagaaaaggcaaccacactccacatcgttgattttggcatttgttatggttttcaatggccttgcctcatacagcgtctctcagcaagagctggtggacctcccaagcttcgtattaccggcatcgagttcccacaaccgggattccgaccagctgaaagggttgaagagaccggacgtcgcttgaaaagatattgtgagagattcaaagtcccatttgagtacaatgtgatagcaaagaaatgggaaaccatccaactggaagaactaaagatcaagaaagatgaagttgtcatcgtgaactgcatgtatcggctaaagaacctccccgatgacacactgtcaccaaccagtgcgagggacattgttctgaaactgatcagaagcatcaacccagagttttcatccatgggatttcaaatgggacttataatgctcccttctttgtca

SEQ ID NO: 15839 - DNA, 890 bp, Gossypium hirsutum
  Predicted polypeptide sequence is orthologous to G989
ttcaaagcttagttcctcaatctccaatcagttccaacactactagctctaatcctagctcctccatgaagtcaaagcgcgtcgaaagagacgtctccgcagctaccggcgaagattccactgctgatgatccttccaacaagcgtcctaactactcctccggcgacaaagcagctgccgccaatgaacatgacgaaacggtgatagaaggtgagtctacagggttaaggcttttaggtctcctgctccaatgcgccgaatgcgtcgccatggataacctcgaggacgccaccgatcttttacctgaaatatcccaactctcttctccgttcggttcatctcccgaacgtgtcggcgcgtacttcgcacacgctttgcaggcacgcgtggtgagttctagcttaagaacctattctccactggataacaaatcactgaccttgactcagtcccaaaagatcttcaatgctctgcaatcttacaattcgataagtcctttggtcaaattctctcacttcaccgccaatcaagccatcttccaagcattgagtggtgaggattgtgtccacgtcatcgatctcgacatcatgcaaggtctccaatggccaggattattccacatcctcgcctcccggtcaaaaaagatccgatcgatgagaatcacggggttcggatcctcgtcggagctcctagagttgaccgggaaaagactggcggatttcgcggcatcgttagggttaccattcgagttccatccgctggagggcaaaatcggaaatttaacagatctgagccaactgggagtccggtcaagtgaagcggtggtggtccattggatgcatcattgcttatacgacataacggggagtgatttggcgacgttgagattg

SEQ ID NO: 15840 - DNA, 550 bp, Gossypium hirsutum
  Predicted polypeptide sequence is orthologous to G1017, G2567
ttttttttttttttattccaacatgatgcgagcaccatttcttccataaatatacagtttctaggactgggatttaataaacatgacaaaggacatagatcctttttatgtggaaagaaaaattcgagttaaccaacaaaacgtggttttacagttccatcaaaagtgggtcaagtggagatttctcacaactaccgtagaagaaatgaaaatcggaaaccgacggctgggaaaactgtacaattggcgcaaattcatctctctatctttctaagtgtcactgcttgaatccatgagaatcgttagcctccttgctgtcttcataaactcgctgaagggctcatctccaggtgtttttaactgaaccggcagcatcgcggtagagcacacgtgctcagcatctctgaactttctatgccaaacatgttggccagcttcccaaacagctcttcatatgatcccagaactgaaagatcaagggttctacctacattctctgattccataaacacttggcaatgaccagtctccaatcctagatcagtttttg

SEQ ID NO: 15841 - DNA, 852 bp, Gossypium hirsutum
  Predicted polypeptide sequence is orthologous to G1017, G2567
cttccctcaaggccacgccgagcactcactcgcagccgtcgatttcccctcgtctccgccggtcccggctctagttctttgccgagtggcttcgctcaaattcatggcggataccgaaaccgacgaggtatacgccaagatcctcctcatgccgttacccaacacagagctcgacctagaaaacgtcgccgttttcggctccgataacgcggagaagcctgcttctttcgctaagacattgacccaatccgacgccaacaacggcggtgggttttcggtcccgaggtactgcgccgaaaccattttcccgccgttggattacacggaggaccctccggttcaaaccgtcgtcgccgtggatgtccacggcgaaacgtggaagccaggcatgctcaatttgggttatctttatccgatctccatcttaataataaactgcaatccggactttttctgcccagtttccagcggttcgatccccactctagaatttccgatggcatcatgatggcaaggcgccctaatggtactgataatctttcttgcttgttaacaatcgggaattctaatgtgaatgagaaatctggcaacacaaaaagacaccagtttttactctttggtcagccgatacttactgagcagcagctctctcgtagctgttcaagtgaagttgtctcacaagttattaacggaaatagttcgttagatggcagtgccgaaaaaacaaaagatacttctgatggttctcgatcttctcttgagaagtcatctactgctggatttttgtggcaccaggattatagaagcgcggaaactggccacgatattggccattgcaaggtattcttggac

SEQ ID NO: 15842 - DNA, 621 bp, Gossypium hirsutum
  Predicted polypeptide sequence is orthologous to G1020
gaacccgagaaaaaaggcccgagtctggctcggtaccttcgacactgccgaggaagcagcgcgtgcttacgacgcggcggcacgagaattccgtggcgcctaggctaaaacaaatttcacctacactaacatcaatgacttcacgctaagccccagccagagcagcaccgtggagtcctcttctccgccgccgttggacctcacactcgctagcggatctatttcgctccccatgacggcgaatcatccggtgtttttcgttgatgtctttgcttccgccggtaagcgtctctccgatgccggcggagcccagagcgattcagattcctcgtcctcggttgttgattttgaacgaggggtgcaaccgagagtgtttgaatttgatcttaatcagttgcctgctgagatgatctgaattcttttccccgtttgtaccggatgtcgttttaagcttcggttttctgcgttttttgctttcctcttttatggtaaaagctgacatgtaacgtgtataaaagaaatgtaactcttctagggacctatttttagcaacttgaggaaatttcgaatttcctcaatgttgtttctacttacttataattgaagtatttccttttcttt

SEQ ID NO: 15843 - DNA, 823 bp, Gossypium hirsutum
  Predicted polypeptide sequence is orthologous to G1020
agaggagtaaggaagcgtccatggggtcgttacgccgctgagatcagagatccagggaagaaaagccgtgtttggcttggaacttttgatacagctgaggaagcggccaaggcctacgacgccgccgccagagaattccgcggcgccaaggcgaagactaatttccccctccctggtgaaattctcaacaatggtagtaactgtaacaacaatggcgataccaactgcaacaacaacaataacaaccacagccctagccggagtagcaccgtggagtcatcaagccacgagccgccgacactcgtcaagtgttcaccgttggatctcaatctcggacacgctgcggtcaccgggtacggatctcctgcggtcaggcttcctttccctcaaatttcgccggtcgccggttttttcgccaacggcgtctcggcagttgcagccccccaagttttttacttcgacgctttggtccgacccggtgttatgaaaggacagcagtatcaacaacggttgagattcgatcaccgtgattatcacgaaacttttaacgctggtgtacaaagcgactcagattcatcctccgtcgttgatttaaaccaccacgagatcaaacggcgaccgcttctcaatatcgatctcaaccaacctgctccggaagtcgcctgattatgattttttaaaatcgccgatatcaagaaccggaaaagaaaacccacaaattttcaattttatctctttaaatcgttatcttcttttagtcccaattttgaaattagacgagaaatatacccaaaagaattacgcgagagcgcgtaaattgtga

SEQ ID NO: 15844 - DNA, 922 bp, Gossypium hirsutum
  Predicted polypeptide sequence is orthologous to G1020
ttcgccctcctccattctatctcaaccccacacataaatccccttttaccaaaggagaacattaaaacatcgccctactcttcgttttcttcaagcggaaaacaggaaactgaggctttcccttctcaaatggcaccgagggagaaaacggcggccgtcaagggtactgggaataataacgaggttcattttagaggagtaaggaagcgtccatgggggcgttacgctgctgagatcagagatccagggaagaagagccgtgtttggctaggaacctttgatacggccgaggaagcagccagagcctacgacgccgccgctagggaatttcgcggcgccaaggccaagactaattttccggtcccttgtgagaatctcagcaaaggtaataactgtaaaagtaatggtaacaacaaccaacatagccctagccagagtagcaccgtggaatcctcgagccgtgagccggcgctcatggttgactcttcgcctttagatctcaacctcgtacaaggtgaggcggttaccggttacgtgcctacggctgttagatttcctttccagcaagcttcaccggtgccatatattgcgggccgcaaagttttctactttgaaccattcgttcggcctggtgcagtgaaaggacacccatttgaacggtttggattcgatcatcatgatcttcatgcgacgtttaatggtgtacaaagcgactctgactcatcatccgtcgttgatttgaaccaccatgaggtcaagtcgcgcccgcttctcaatatcgatctcaaccaacctgccgttccggaaattgcctgattttttttttaatattcgcagatcgtcaaagaggaaggtcaaaaaaacgagttttttaaattttcgttgtttaaacatatttttcttagcagtcccacgaaatatc

SEQ ID NO: 15845 - DNA, 855 bp, Gossypium hirsutum
  Predicted polypeptide sequence is orthologous to G1020
ggcacgaggttcatctcactactgttcaagaaaagttacttaaagaaaggaaaaccatggctcctagatcaaaacccagcccgattagcccgaatcccgacccgaattctaaggagatccgctaccgcggcgttaggaagcgcccatggggccgttacgcagccgagatccgagacccgaggaaaaagactcgagtctggctcggcaccttcgacaccgccgaggaagcagcgcgtgcttacgatgcgaaggcgcgagagttccgcggcgctaaggcgaaaacaaatttcgccgacaacaacgccaacgacttcacgcgcagccctagccagagcagcaccgtggagtcttcttctccgccgccacttgaccttactctggccagcccgtgttcttccctccctgtgacggcgcagcgtccggtttacttcttcgatgccttcgctactggcggttcgggttgccccgcatccggattcgctcaaagcgactccgattcgtcgtcgtctgttgtagattttgaaggaggagtgcggcggagagtgtttgatcttgatcttaaccagttgccagctgaaatggattgatttgcctccttttttcaatatgtcgttttcagcttcaattctcagcgttttgggctttcctctttttttatttttcccttaatttttgggttaaaatttaaaactgacatgtaatgtatgttgtgtgtaaaaaaaaaattgtaactcctagagatctatatttttggcaacttgagaacattttctcaatgttgtttcccctttattataattaaaaaaattaataacataaattaaatgctttttcataaaaaaaaaaaaaaaaaaa

SEQ ID NO: 15846 - DNA, 475 bp, Gossypium hirsutum
  Predicted polypeptide sequence is orthologous to G1020
ctcgagcggggcggccggggcaggtgcaaagcgactcagattcgtcctccgtcgttgatttaaaccaccacgagatcaaacggggaccgcttctcaatatcgatctcaaccaacctgctccggaagtcgcgtgattattattttttaaaattgccgatatcaagaaccggaaaaaaaaacctacaaaatttcaattttctatctttaaaatcgttaatcttctttttagtcccaaatttggaaaattagacaagaaattatacccaaaaaaaaattacgcgaggaggcggcgtaaattgtggaatacgtagatgaaaaacctcccttttttgcagcagagaaacgttagtttgtagtctgttgtttcatattaatttctggtaattcttttttattttcaatgaattaattagtaattacgaggaaaaaaaaaaaaaaaaaaaaaaaaaggcttgtacctcgggccgcgaccacg

SEQ ID NO: 15847 - DNA, 550 bp, Gossypium hirsutum
  misc_feature (507)..(507): n is a, c, g, or t
  Predicted polypeptide sequence is orthologous to G1023
agaaataatagaaaataaaaacttcgttcgctgcaaatagacaaatatagttgtcttaacatgtgaggatgagcagccaaaaattaaaaaaatcatctaaacacttttctcagatagcttaatcccttggatggctctttagcacaagaaaacccaaaggatttttcgtcgctcattcctctcaactcaccaaacaaatcatttcgactcactcacaaaaattgaactacccaataacccatcttggagagccccccaagtaccttcaactttgactaagaactcatgacaacaaggtttatattattaaaccactactactattacctaaccgcaaaacttatgggcacaaaatgttgaggggggctacttttttgcaaaaaatcgaagtcatcagtgctaaaatcacaatcaggtagttcactgggttcatttccttcgatcccacaaatgctcaggtcttcaatgctgcaataatcctccaaaatcacccgagaatcattgacnaaaagataatcggatggctcttcatctaagttcagctcttgtc

SEQ ID NO: 15848 - DNA, 803 bp, Gossypium hirsutum
  misc_feature (743)..(743): n is a, c, g, or t
  Predicted polypeptide sequence is orthologous to G1023
gcggccgtcatcgacatgcaaccgattcatcttcaagtgaagatgaatccgagggaagtgctgctagaaaggctccaaggggaaggcgttttgttcgtgaaattagagttcctgttttaggcttggctcctcaggtaaagcctcttgaatccgagacatcttcacaagacagtaactctaaaacccctactagcaggaaaagggttttgagtaaaacccttgaagacaaacctctggtggctaaaaccaaaaaacctgttggggttcgtcaaaggaagtggggcaaatgggctgctgagatcaggcatccactcaagaaaaccaggatttggttgggaacttacgatacccttgaagaagcagccaaggcttatgaagctaagaagctcgagtttgaggctctcactgttgctgccgccgcctctgcttcatctgataaaaccaacgacctttcatgttctgcagctgcttctcacaacaacactgttccctctgcttcagaagagtctgagagccttgtatcgcatacttcaccatcctcgatgcatgagttggatacttctgcatctgtttcagtctctaataacaatgatgattgcggtgatgccaacaaagaggtgttcgatgcgaactttgctgatataccgatacctgacctctgtttcattgatgatccattgctatctggctcagttggacaagagctgaacatagatgctgaggctgctgattacctgtttgtncacgattttggtatgatgttggaagattattgcagcattgaggacctaagtatttgcggg

SEQ ID NO: 15849 - DNA, 807 bp, Gossypium hirsutum
  misc_feature (483)..(483): n is a, c, g, or t
  misc_feature (517)..(517): n is a, c, g, or t
  misc_feature (549)..(549): n is a, c, g, or t
  misc_feature (563)..(563): n is a, c, g, or t
  misc_feature (595)..(595): n is a, c, g, or t
  misc_feature (625)..(625): n is a, c, g, or t
  misc_feature (755)..(755): n is a, c, g, or t
  Predicted polypeptide sequence is orthologous to G1033
ttctgttctctttcttcccccctccccctttcacatcaaccctaaccctacctcaccaatcaggatacaacatgaagggaggtaaatccaagtcagatactaagggctctaggctcgccgtgaacaaaaaatctagcgccaaagctggaaagaaatcggggaaggcggctaaggatccaaacaagccaaagaggcctgctagtgccttcttcgttttcatggaggagttccgtgagcaatacaagaaggaacacccaaaaaacaaatctgtcgctgctgtgggcaaagctggtggagataaatggaagagcttgtctgatgctgaaaaagcaccttatatagcaaaggcagagaagcgaaaggtcgagtatgaaaagaacatgaaagcctacactaagagacagactgaggctcccaaagaaaaaaatcggagtctgagaagtcagtgtctgaggtgaatgatgaggaagatgaagacgatgnaaaaagccgcggagaagaagaaaatgatgactancaaagaaggaagacttgttggaagagatatancataacaagtatangctggtgcttaattggttatatgttaatgctnttgatgttcccatgttattctctctaaatnggcatatgcatgttcatttaagggaaaaaaaaattgtacctcttaatcttctgattttctttccaacgtttaatagattaatagcctcaaaaatgttcctttgattccaacgtcgaggaatggcttgtanacatatccttttagatgataacttgatgccttatttagaaaaaaaaaaaaaa

SEQ ID NO: 15850 - DNA, 836 bp, Gossypium hirsutum
  Predicted polypeptide sequence is orthologous to G1033
ttttttttttttttttttatcggactaattctctacaaaaggatttatctaagccattcaactttaaatcaaaaagtacatatagaagcagattatcccatctacaactattaatttcagaaggtcaaaaggaaccaacaggattcagaggtacatttctcccttagatggcatgcgcatctaaaagaataacatggaaacatcgaaagcattaacatatggttttgatcaaacactatcacagcctacattgattatgctatccaccacggaccttcctactcatcatcttcttcgtctccgctgccttcttcatcatcatcctcatcattcacctcagacactgatttgtcagactcaacatcttcgtctttaggaccctcagcctgtctcttattgtaggccttcatgttcttttcatactcgacctttcgcttttctgccttggctacataaggtgctttttcagcttcagacaagctcttccatttatctccaccagctttgccgacagcggcaacggatttgtttttagggtgatccttcttgtattgctcacggaactcctccatgaaaacgaagaaggcactagcaggcctctttggcttgtttggatccttggcagccttccccgatttctttccagctttggatttcacggatagcttggcactcttagtatctgacttagattttcctcccttcatgttgaatcctggttggtgaggtagggttagggttgaaaaaagagagagaaaaggggaaacaaaggagagatatgagattggggattgaggattgaggggtgagttgaaaggccgaaaggcggagatatt

SEQ ID NO: 15851 - DNA, 550 bp, Gossypium hirsutum
  misc_feature (7)..(7): n is a, c, g, or t
  Predicted polypeptide sequence is orthologous to G1033
aatatcngactttcacatcaaaacaattagtcgtgtgaacatgtccaaagaacatatcaaacagataaaccatatcacgcaaaaccactaccacttcaggaagcgataagcataaccacacgcacaaaaagaagaaaaaaaaaccccttagtcattcatctttaagagaaatttaagtacaatatccatgaaaaaagttactgcttcaactaacccgtttatatccttctcttacctaatctaaaagtacgactgttggatatcaatatcaagtcaactgttcatctctaagtagcaaaacaattcctgaatcaatctaaccacttctgcaaattagttcatctagtcttcatcctcatcctcatcctcttcatcctcgtcattgacttcagactttgacttgtcagattcatcatcgtttcctccgccagccagcttcagactatatgcctgcatcttcttattgtattcacttttgcgcttctctgccttctgtacaaaaggagctttctcagcatctgtcatgcttttccatttttctccaccagct

SEQ ID NO: 15852 - DNA, 834 bp, Gossypium hirsutum
  Predicted polypeptide sequence is orthologous to G1033
gcggccgcgtcgacattctcaacacatctctatttctatcgcacttttattcccctattcctctctccctctctcatccgtaactctaaccctagccctctatcaggtatttccccgtcgatttttatcgaatttccacttctttctatcgatttcatctgctttttcactcatctgcgatttcatttgcaggattcaaacatgaaaggaggtaaatccaagtcggatgccaagagcgccaagctctccgtgaataagaaatcaaccacgaaagctggaaagaaatcggggaaggcagctaaggatccaaacaagccaaagaggcctgctagcgccttcttcgttttcatggaggagttccgcgagcaatacaagaaggagcaccctaaaaacaagtccgttgctgctgttggcaaagccggtggagataaatggaagagcctttctgaagctgaaaagcgaccttatgttgataaggccgagaaacgaaaggtcgagtatgaaaagaacatgaaagcctacaataagagacaggctgagggtccccaagaagatgaggaggaatctgagaagtctgtatctgaggtgaatgatgaagaagaagatgatgatgaaggcagtggagacgaagatgatgagtaggaaaaatccagggaggatagcataatcaaactaggctgtgatagtgtttgatcatcttatgttaatgctttttaaatgcaaatttcatttaagcaaaaatgtaactctggatgctgttggtttcttttgacgtttcgaaattaatagttgtagatgggtaatttgttgctacatgtactttgcatttgaagt

SEQ ID NO: 15853 - DNA, 629 bp, Gossypium hirsutum
  Predicted polypeptide sequence is orthologous to G1033
ctcctaaggaccccctcacaaatatcttctttgctttgctttagttagtgttctcttttctgcaattctctgttttttctacatttcttttccattgaagaggaagctgtcttgtaagaatgaaggcaacaaggggcagagaagatgcaacaatgaaggacaagaaggaagcaaaaaagcctgctgagaacaaggtcgtcggtaagcgaaaagcggcgagccgggccgataagagtgaccgaaaacgcgcaaagaacatagcatcatcgaccaacaaggacccgaataaaccgaagagacccgccactgctttctttgtgtttatggaagagtttaggacaagttacaaacaagaacatcctaaagtgaaggctatctcagctgtgggcaaagcgggcggagagaaatggaagtcgatgtcgaatgcagaaaaagctccgtacaaagtgaaagcaacggaaaggaaatcagaatacgagaagctcatggcagcctacaacaagaaacaagaaagttcagatgatgaggaggaagctgagtccgaatcatcaaaggatgatgaagaaagtgaggacgatgattgaatccaggatggttttggattaggttctgtaaatgaaaccatgttt

SEQ ID NO: 15854 - DNA, 871 bp, Gossypium hirsutum
  Predicted polypeptide sequence is orthologous to G1043
caaatagggaacatggcttataatattaactgtacaaagaagccaaagttttactaagcaaaatcagggtcatcaaactgcaaaccattttcaagctcaacaggttctaaatccaaacaagtgatttcagtgcatgaatacatgttggacaccacatcagcttcaaaaccaacaccacccatcattacatccgtccacatggtcatcgaatccaaatccgtaacatcgcttggtgtcgtcgtttgttcctcagattcgagttttgatatcagactcagacggtcgattcgtggtgtagccatggatgagtactggcctctgcaagtgtgggtaccaatgtatgtgatgtggtacatttgggtatcatcttccattctttgaacttgtttgatagcactacagccttgatcatgcttgtgactgcacctaaagtaactccttggatgtttagaatttaagatatttttttgtccatatttcctccatgcatgcccatcttctattttatcagacaccactgtgcttgtttgagcaaacctctttctcttgtaacagcccctcttatccttggcgaatgctgaaagtgatctcttgctgctctcactagaatcttgagacttacaatcatcattacaagttgcctgattctgggaaatcacttcatcatgatgaccagcttcagctagcatagaaattgtttgattaaatgaccacaagatcttttgcacaagctcctcagcttgttgagagggcttgttgttctggagtacaataacttgaagctcagtagcacactgttgaccttccgcaagttgttgtattacccttttcttgttgcttgatagtgtttcaggttcaggccatggataaa

SEQ ID NO: 15855 - DNA, 861 bp, Gossypium hirsutum
  Predicted polypeptide sequence is orthologous to G1043
gcggccgcgtcgacctccgctgaggaacttgtgcacaagatcttcgcatctttcgaccacgcactttctttgctgactgctgttgaatctgctgaggattctcagaatcaggcaacttcctacgatgattccccttgttgcaatggcaggtctgaagattccactaacagcaggaagaaacttgcttctaaggaaaagagaggatgttacaagagaaggagagatgaacatgcatggacagtagtttcttcaaccgtggaagatggtcatgcatggagaaaatatggacaaaagcagatccttaattctaagcacccaaggagttactttaggtgccctcgcaagtacgatcaaggttgtagggccactaaacaagtccaaagactggaagatgatggctcccaaatgtttcagaccacttacattggaacccatacctgcagaccagactcattcaaggctccccaaatcatcatagattctgaacctcgggaatcttacagcaagttcagttatggcagcagcaaccccaaaatgccaaccaaaaagctgcacgaaatcactccacctgtaaagcaggaaaccaaagaagaaacaccaacaacaagtggtcttacagacatggattctgttgtgatgtggaaagacataataggtgctgaatacggggatgtggcctctaacgtgtatacgagcactgaaatcacttcccagaatttggaactggaccttgtaattaagcctgtagagttcgaagacgattttcagtttgatgaaagtgagttcgtctagtcatcatcatattaactgtatctacgatagtttgtaatcagtaatgtggaataataataataaccattg

SEQ ID NO: 15856 - DNA, 977 bp, Gossypium hirsutum
  Predicted polypeptide sequence is orthologous to G1048
caaagttcaaaaggtgtttgtttgtatattctgatcggttcaatttcatgtgtcactcactttcctttcccatcttaaacatgctccctcctctgtaaatcctattagacgtcaatttcccctttcataaatctttgggttttcatggaggaaatcaattgggatacccttctgctcgaggttgacttacccgatttcgggaatatcttagataatgaaccggtaacggaacctcctcctcaaccttgttcaacccagaatcccgatgaagaaccggcggtgtcttcgtggatcggggcgatcgagaaggttttgatggaggatgataattttgatcctagggttgagactcaacctgtctccgatgatgatttcttggccgatttactggttgattcacctcctagtagcggcggcgatgtggctggcgtcgacggtgctgatttgcacaaacagagccagacccacaccgacgtcgataaagacgatcccattattaagaaacagagaaggcagttgagaaacagagatgcagctgtgagatcaagggagaggaagaagatgtatgtcaaggatcttgagatgaagagtaggtatttagaaggggaatgtagacgactgagccgtgtgcttcagtgcttcattgctgagaatcaagctcttcgtcttacgttgcataagggttgtgcatttgatgcatcctcggccaagcaggagtctgccgtgctcttgttggaatccctgctgttgggttccctgctttggttcctgggcatcatgtgcctcttcaccctgccaatactgcccaagtcagttctggaggcagttccaatggcaaacgaggaaacacaagtcccgaaagagtggctccaagaggggcaggagtaaccgggtcggaccatcttttgtgagagtagagatgcaaggcgtctaggggaaagatgaaagaaatttcatgttttatgggaattttaatt

SEQ ID NO: 15857 - DNA, 804 bp, Gossypium hirsutum
  Predicted polypeptide sequence is orthologous to G1048
cagaatttcttggaagcctgcctgcctgcctgcctgagttttctcttttaattcattcaattcgaataaaattcaagcacctttgtaaattgtacatgatttctcttttcttcttcctctgcttgtaaatatttgataaaattgcaactttgtttgccttattctttgggtaatcatggaggaaaccaattgggaaagcctgttgtttgagtttgactgtcccaatcttggaaatatcttacaaaatgaatcagaatcggtaactccaccaatctccacccactctcccgatgaaaaaccgatttggacatcctccattggtgagatcgagaagcttttaatggaggacgatcgttttgatgacaaggttgagactcaacctatccccaatgagtttttggcggatttattggttgattcatctcctagtggctgcggcgatgaggtcatcgatgatactgcttttgacaaacaaaaccagacccttttcaacgttgataatgatgatcccattgataagaaacagagaaggaaattgagaaatagagatgcagctgtgagatcaagggagaggaagaagatgtatgttaaggatctggagatgaagagtaggtatttagaaggggaatgtaggagactgaactgtttgcttcaatggtccattgcggagaatcaagctcttcgttttactttgaaccagcgttgtgcatttgatgcttcctcggccaagcaggagtctgctgtgctcttgttggaatccctgctgttgggttccctgctttggttcctgggcatcatgtgcct

SEQ ID NO: 15858 - DNA, 911 bp, Gossypium hirsutum
  Predicted polypeptide sequence is orthologous to G1050
gtttgtgtatatgtgtgtgagaaaggtagcagtatagcacttgttctttgtttttaaggaaaaatgggagatagtgaagaaggtaatactgatttgatgcaaaggattcaatcatcatttggaacatcatcttcttcgattcctaaacaagttttatcaatgaatcatcttgaaatacctccactgaaccctaatcaaatcagggctgttaggcatttctctcattttggacaaaactttaacggcggcggcggtggaggtggcggcggtggtgatggtaataaaagagttggtattcctccttcacaccctaaccagatcccacccatttcgccttattcacagatccctgtgtctcgtccatcgagccatcaaatgggttcttctcagggttttagtcccggaccgactcattctcggtctttgtcacaaccttcgtcgttcttttcgttcgattcgttgccgccgttgagtcctgcgccggtgagccaaatttcgaacgatgtgtgtatggaagattcgcattcgttgttaccaccctcgccttttccaaaggcgagttctcctcgggttggagaaagtttgccaccacgaaaatcacataggcggtccaatagtgatattcctttcgggtttaatacggtaatgcaatcttcacccccaccgttaaggggcagcggtttcgagaattcgggtgtgcctaggccagttcagttggttaaaaaggaaacgagttgggaaagaggtattgatggtaacgttgaaggaatgggtgagaggaaatcggaaggggaagtcatggacgatttgttttcggcatatatgaatttggataacatagatgcattaaattcttccgaggataagaacaacaataacgagaatcacgaagatttagatagccgagcgag

SEQ ID NO: 15859 - DNA, 945 bp, Gossypium hirsutum
  Predicted polypeptide sequence is orthologous to G1050
gtgaaattaagagagagaaagcgcctgccgctaaattcggcggagattttggtggtgttgccaccttgctaacttgcacctccgctgccccatttgtttttttgctaaattacgccggacggccattgtttttgctcatttctttccccttgctttgacctataattacaagattctggtgagtttgatttgctcatattgttgttgtttttctgttttggagtgaactgggttaagcttttaattgtccaaagttttcatctttttgagtttttgtgtcatcattgtttgtaagaaagaaaagaagaaattatgggtgatggtgaagaaggtaacactgatgtgatgcaaaggattcaatcttcatttggaacatcatcatcttcaatccctaagcaacctttatcgatgaatcatcttgagatacctcagttgaatcctaatcaaatcagaggagctgctagacatttctctcattttggccaaaactttaacggcggtgctgctgctggtaccggtgatggtgctactaacaaaagagttggtatccctccttcacaccccaaccagatcccacccatttcaccttattcgcagatccccatgtcccgcccttcaaaccagcaaatgggttctcagagttttaactcgggaccaactcattcgcggtctttgtctcagccttcatccttcttttcactcgattcattgccccctttaagcccttccccgtttcgtgattcttcatccatggcagtctcagaccaagtttccaccgatgtgtcgatggatgaaagggatgcagctgcttcacattctttgttgccaccgtcgccttttcaaaggcgaattctccacggcttggggaaagcttgcgcgcgaaatcgcatagcgctcagtagtgatattccgttgggttatacgatatgcaatttcgcgctctat

SEQ ID NO: 15860 - DNA, 659 bp, Gossypium hirsutum
  Predicted polypeptide sequence is orthologous to G1050
accctgcaactgaatctaccacattatcggcccaattaacacttctacagagagattccgttgggcttaccaatcagtacaatgagttgaagtttcgtattcaatccatggaacaacaggcacaactccgtgacgctctaaacgaaacattaaccgcggaagtccatcgattaaagcttgctactcaagaactaggcggcaattctgatccatccaaaggcatggtctcgcagcagcttcccattagccgccagatgttccagctacaccagcaacagttccaccagcaacagcagaacgggaacacagctgcaaaatccgagtcgaatcagtagctcccaagtcccggcatttgtaagatttgaaaaaaatcaccgtatgcctcattatttcataacttcatctgcatccattcattggtttctgatttccaagtttgacgagtttcatggtcgtggtaaaatcacggttcaacctgcctcaggtatccatctcggataacggaataaagtaatatatatagcttaaacaattatatatcatatatagctatagttctttacttatttatggtagataaattatattggaatgtaagcagcaagtttgacatgatttgttgcattgacaacacaaaatattggctttctctttgtttg

SEQ ID NO: 15861 - DNA, 965 bp, Gossypium hirsutum
  Predicted polypeptide sequence is orthologous to G1051, G1052
atcattggcttcaaaggacttatatcatatgatgttggtgtttgggtttgggtttgggggtttgagttgatatatgtgtgtcgtgtaatatttttgtgtgtttggttgtatagttagttgttggttagtttaagattagctttgtttttcgtgctctttttatttatttatatatatttttgagtttttggggtttgtgacattggcgtagaatggcacaattacctccaaaaatacccaacatgacccagaattggccttcttttccacatcaaagattgcctacaatggcaaacttcatttccaccactgccaacaccgccactatgaacgcctcccacaaccaccagccttcttgggtcgacgagttcctcgacttctcctccgcacgccgcggggctcaccgccgttccattagcgactccatcgctttccttgagcaaccattggtggaggaatgcagggactccaacaccaaccacaacaacaatgccatgataacggaaaccaatgtgttcgatcgtctcgacgacgaacagctcatgtctatgttctccgacgacgttgccgtcaccatggctgctgcaccgacgttatcctcgtccaacccttccactccgacgtccgatcaaaacagcaacaatgacgagaaaccagtgccgtccctggatctgcagcagcccaagaacgaaccaggagaagtcgagagctcatgcaaacctgaaccacaagctgctcaacctccatcaacctctaatggcgatcccatcgttgatcccaaaagggttaagagaattctggcaaaccggcaatcagcacaaagatcaagagttagaaagctgcaatatatttctgaacttgaaaggagcgtcacaacattacagactgaagtatcagcattatcaccaagggttgcattcttggatcatcaaagactgattctcaatgttgacaatagtgctttg

SEQ ID NO: 15862 - DNA, 918 bp, Gossypium hirsutum
  Predicted polypeptide sequence is orthologous to G1051, G1052
atggctgaactacctcctaaaatacccagtatctcccaaaattggccttcttttcctcatgacaagatgccttccatggcaaacttctttccctccaccatcaccaaccacccttcatgggtggacgagttcctcgacttctcctccgcccgtcgcggcgctcaccgtcgttccatgagcgactccatagccttccttgaacaaccattggtggaggaagaatgcagggactccaatgccatgcccatgatgactaccacgacggtatcaaatttaaatatgttcgatcgtcttgacgatgaccagctcatgtcgttattctccgacgatgtcgccgtcaccatggcagcgcctgctccaacggtatcttcgtccaatccatcgacgccgacgtctagcaacaatgaggagaaaacagcaccctcaacggatctgcagcagcccaaaaatgaaccaggggaggtcgagagcacacgcaagctatccgcctcagaagctccaccatcctccaacggcgattctatcatcgatccaaaaagggttaagagaattctggcaaaccggcaatcagctcaaagatcaagagtgagaaagcttcaatatatttcacaacttgaaagaagcgttacaacattacagactgaagtatcagcattatcaccgagggttgcattcttggatcatcaaaggttgattctaaatgttgacaatagtgctttgaaacaaagattgctgctttggctcaagataaaattttcaaagatgctcatcaagaagcattgaagatgaaattgagagactaagacaagtctatcaacaacaacaaatctcaagaacatgaacaccacaaccaccaaccgccatgcactaccatcacacaacacaaccgcctccgtcatccgcacgcacaaatgaaga

SEQ ID NO: 15863 - DNA, 1432 bp, Gossypium hirsutum
  misc_feature (1333)..(1333): n is a, c, g, or t
  Predicted polypeptide sequence is orthologous to G1064
aaaccattagagaaacaacttactactttgatgctatcatggaaggaggaggcagtgatgatcatcaccaccaccaccacagccaccaccatcaccaccaacaaccactccaccatcatcatcatcaccaccaccgccctactttcccattccaattactagagaagaaagaagaagataaccaaccttgttcctcctcttcttcccttcctttcccttccctaccggtttcatcttcctcggccgatcaacacacctcgactcgttccatttcaacccaccagatctcgccggaaacttccaagactccaccgcctaaacgtacttcgactaaagaccgacacaccaaggtagatggacgtggtcgtaggatccgtatgccggctctttgtgcagctagggtttttcagcttactcgcgagttgggtcataaatacaatggtgaaacgatcgagtggttgctacaacaagctgagccggcggtgatcgccgctacggggactggtaccatccctgcaaacttcacttccctcaatatctcactccgtagctccggttcaagcatgtcggttccttctcagcttcgttcctcgggttttagctctaacttttctatgcaacaacgtagaagcttgttccccggaatcgggctcgaaacgacgccgacgccgacgacgttccttaacttccaatctagtagtacttcgttgggaatatcggaagaagccgaagaaagtagtttaggaaggaaacgaagacccgaacaagatttatcttcacaacatcatcagaatggggagttacttgttgcatcaagcaccgtacattccggcgagtcaccacgctcaagttccggtaacttttggatggtaactaattctaataatcaagctatgagtggtggtgaccctatatggacattccttcagttaataacagtggtttgtataggggaactatgtctagtgggttgcatttcatgaactttccaacaccaatggccttgttaccaggccaacaattgggttcaagcagtagcggtgccgatggaggcggcggcggaggtggcagtggtggaagtagtggcataagtgaaggrcatttaaatatgttagctggattgagtccttattagacaagactccggtggtaccggcgtttcggaatctcaagtgagtggctcacattcacaccacggtggtggaggtggcrgcgatgaatgacgtgatttacaaaccaatagtgtcatgcgatcgtagagatgatgatgatgatcatcgaacaaagcatcatctttgctttcttttgatcacttgtgtagtttgatgtgtancacacgtgaggtttgattgctccttttaatttttttttccaaaaaaacatgaattgagtttttattataccaaaaaaaaaaaaaaaaaaaaaaaaaaaa

SEQ ID NO: 15864 - DNA, 744 bp, Gossypium hirsutum
  Predicted polypeptide sequence is orthologous to G1082
aggctaggaatttggatagagaggatcagaagctgcagaaagatatccaagcattagataagaaaattgttttggtctctggagatggtagcagtctctcggtagctggaaatgttgtatatcagagtgagactagcaacagtagtttgcaggggggcttgcaacgcatatttgaggcaatggaaaagttcagttccgagtcctccaaagtctatgaggaacttttgcagcgtgtgaaagaaaggattgctgaagaccatgagagagtatcataggacccactaaaaaaaaaatgactatggcatcccttggaactgatgatcagtttaggcagtctattgccctctcagaaatggagctcaatgttgggttggacgggtcctgcaaacatacaacttggctggttgctctactgtcagggaagacttgattatgaatgagttggaagagacataagatgggagctaaccttggaattgttagatgattcatcatctgccttacaggagtaggtttcggatgggcttatggcatcgactgtcaagcttgtcaagagccgaagacagatattgcatttccaaaatctcactcaaggtgcaactctagatatcctgtccagtcggcatgaagcagcacccgtatcattgaagaatatcaggcaaaggaaagcagatggtgtgccaaaccattggagtaagcagattctccatcagttttgtaagatgaagagttttaaaaatgtag

SEQ ID NO: 15865 - DNA, 550 bp, Gossypium hirsutum
  Predicted polypeptide sequence is orthologous to G1084
tgagaaaagaatcaataaaaaaattgatagactgaaagtatcaacagattctcccccaccaagattttttagttaaaaaaattataaaaaaggaaggctaacattttaccttaaaacctagtggcaaatacttaacattctttagttacaatcacattttctgttaacttcaacccaacacaaatctagaaacatactcccatcttctattttagaagattggggatgagggggtgataaaaaagatgagaacaggaataagggctctttcgcgcttcgggagggaggagagaaaaagggaataagctgccccacccaggaacaaacacaagttgcttcttcacggatctgtggcaaccatttcttgatattttgatacaatggcatgtgctatgggttttaggggcatctgaaagtgtgagaatcaacgtgtaacctttaactcaccagttttgggggaaaggaaaaaaggagcttttgccatcagcaacccaaacaaaaagttaaccatgcaaatacatttcttggaccatcttttatgcatagtaca

SEQ ID NO: 15866 - DNA, 891 bp, Gossypium hirsutum
  Predicted polypeptide sequence is orthologous to G1100
ctcttgcagccctcactttctcagtgtttgtacccaacaaagtcttttcttttcttccctctctgttcccaacaatggaacagtcatccaacctcaagccctcccactccttgtttcaagttctcactccaactcaaccccttcaatttcatatttaaacactgtcaattcaaaatggatagcctttcaactgcttcagtctcgtttctacttcttgttttaagctggaaaagttgattttctttgctgtcaaacgaagttttttttttttttccttagagaatatatataatcaaaagaggagaaaaatgatatcaggagggctaaatttggtgatgactgttataggtttcacagtgagtattatgttcatagtgtttatttgtacacgtttgatttgtgctcgtattcagctacgtgcttctcggagacccttcgcaatctcttcaagatctgatcttaatatgctcgaacggggtttacacggtattgagcctgttgttgttgcgaatttcccaacaaagactttctgtgatgagtgcttctcagctaacaaagatgctcagtgcacggtttgcctttctgaataccgccgcgaagatgtgttgcgaatcctcccgtattgcgggcactccttccatgtaacatgcatagacctatggctgcaacagcattccacctgccctgtttgccgaatatcgctgcgtgaattgcccgaaaagaaaaggttgatgcaaccgttgttcagttcggccgatcgttctcattttggcacagaatcttttaatatgcatacgtacaactgtttgttgagagggcacagatttccctcaagaaccagtgagagccctgagatggacccaaaccaagagaattcatttgcaactggaa

SEQ ID NO: 15867 - DNA, 783 bp, Gossypium hirsutum
  Predicted polypeptide sequence is orthologous to G1108, G2394
gccctgcataatttccatccttggtatccaagaggatttttcaccaactagaggagccaccagggaaattataaatgcattgccaacattcaaatttaaatccaagaaaaccggaaatgtaaacgatcaggaaatttcaactagtgaaggtggtgtcctggctgcagggacggcaaaggaacgtgttatatccggggaagatgcagtttgttgtatttgcttggctaaatttgcagacaacgacgagctgagggagctgccatgcctccatgtcttccatgtggagtgtgcagataaatggttaaaaatcaatgcatcttgtcccctatgtaaaactgaaattggtgagagcagcagtacttcaccattagcacaagactcgcattaacagtgcaggcaagacaatcgtcaatggacgaatgaccggtaatgtcttcaatgttttactttgttctactggttcttgcatttaagtttgagtcgaatcaagccgagttgtcacgagtcccccatgcaagagatacaaatatatagttaggctatcatcaaaaaagaaacttgcaatgctatatactaaaaaagattgttccttgaggctaacctctcatggtcatacaaaaatattttgattgctattgctcttttatactatggtatcgcgaaacatgactgtcttgaattttggtgggaacatttcctctaaagtcggatattttgtgggtcaaaaccaatccctcgtatcgcctctcactctcccctacccccttccccctcggtccccct

SEQ ID NO: 15868 - DNA, 550 bp, Gossypium hirsutum
  misc_feature (83)..(83): n is a, c, g, or t
  misc_feature (238)..(238): n is a, c, g, or t
  Predicted polypeptide sequence is orthologous to G1108, G2394
tttttttttttttttttttttaaaaaattattatcattttttatttaatataaacaaattggtttacaccaacagttgcaatngggggaacgatactgaaaaaaaaaacatgatcacatgaatgtacgaatatctcaaaatcttttgtgacacaacataaaataatataaatacgattatgatataacaaaatacataaaaatagctatgaatacaagatatgaaggtcgaatgtttngggacattgcttcgtctttcaactgtcatttttccggtatgctgttaatttgaatctccggctgatggcgaagtacagtcactggtgttgccaacctcggttttacaaaggggacaacatgcattgattcttaaccatttatctacacactttacatggaagacatggatgcatggcagctccctcagttcgtcatcgtctgcatatgctgccaagcaaatacaacaaaccgatcttctcccgatatcacgcgttcttttgcagtaccggaagccagaactccacatgaaacgtccggatcatcaacatttc

SEQ ID NO: 15869 - DNA, 550 bp, Gossypium hirsutum
  misc_feature (14)..(14): n is a, c, g, or t
  Predicted polypeptide sequence is orthologous to G1108, G2394
aaaaaattatatcntccattattttatttaatataaacaaatttgttaacaccaacagttgcaataaaaaaacgatactgaataaaaaaaacatgcatcacatgaatgtacgaatatctcaaaatatttttgacacaacataaaataatataaatacgatttaatataacaaaatacataaaaactagctatgaatacaagatatgaaggtcgaattgtttaacgacattgcttcgtctttcaactgtcatttttccagtatgctgttaatttgaatctccggttaatggtgaagcactgtcactggtgttgccaacctctgttttacaaaggggacaacatgcattgattctcaaccattatatctacacactttacatggaagacatggatgcatggcagctccctcagttcgtcatatgtctgcatatgctgccaagcaaatacaacaaaccgcatcttctcccgatatcacacgttcttttgcagtaccggaagccagaactccacatgaaacatccggatcatcaacatttacaattttcttaga

SEQ ID NO: 15870 - DNA, 746 bp, Gossypium hirsutum
  Predicted polypeptide sequence is orthologous to G1133, G1137
gcttagcgtggtcgcggccgaggtaccatgactgcccaggatgagcaatttgagggaggtagtgaagaggttgatagctctacaaggctaattaaaaagcgaaaactgcttgatggcagttatggttgtttgcccttgcttatggatactgctaattcagggaattttaacagatattctgaatacgaggatgatgcggattcaagctgtgccaaaggccaaaatcctggatcaggtgatacagattcgtcttcaagctacaagagaatgagaaaggataaaattcgagagacggtgactgttttgcgaagcataatcccaggcggagagggaaaggatgcagttgcggttcttgacgaagctatcaactacctgaaatccctgaaacttaaagccaaaaccttgggacttaacactctatgagctgcagcctgcagctgttctcacaagtagtattagttgttatttttgtcattgttagtggagctgtgttaaataagtgaagtatacacaatcttgaatggtgtttttcatatataatttggagcccttccaaaaatagaagatcgtagacaaagaacatgaacccttcccaatgatatgagttggaaaccagtagcataaggagtcgaaatctcatctctatttcctaaaggaagcaaaggatacatgagtgtatactatgtcccaataaaggaagatgaaccatcattagtcaacatcttgggttgtagagaaagtgaaac

SEQ ID NO: 15871 - DNA, 828 bp, Gossypium hirsutum
  Predicted polypeptide sequence is orthologous to G1146
gcggccgcgtcgacattgtatcctatgatggtctgttgacattttacattttatccgatgttattattgtttccctgtgatctttctggttgcctgtcatcgcaggaaggagcgacaatttaaggttgcaatcaaactggcctccaagccagaccttcattatctgagggagtttttgagcagaaggcattttgaatgccctcaagaagctattcaagttctgaatgttgttcttagagctaaaccatctcagatatatactgaggttggaaggtcttttttccatacatcattaggtcctagaggagatcttggtaatggaatagaatactggtctggatattatcagagtcttcgactcactcagatgggtttatctcttaatattgatgtgtctgctcgatcattctatgagccaattttagtatcagagtttgttgcgaatcattgcagactatcaaacctgtcaaagccgctgtctgttcaagatcatattaaagtgaaaagggccttgaggggagtaagagttaagctcatctacatgatttatgccaaaacttgcaagattattggagtatctagagaccctataagtcagttgacatttactctcgatgacaagagagcaaatgtctctgtggtcaagtatttccgtgagaaatacaatgttgtgcttaaatatccatccttgcctgcactttaaagtggaagtcaagctagacctgtctacctgccaatggagctttgtagtatcgttgagggtcagagatacacaaaaaaactaaatgaacaacaagttagatctctgcttagagcaacttgtcaacg

SEQ ID NO: 15872 - DNA, 1003 bp, Gossypium hirsutum
  Predicted polypeptide sequence is orthologous to G1146
caagcccttctattgcagctgttgttgcctctcaagattggccagaggttacaaagtatgctggcctggtttgtgctcaagctcatcgacaggagctcatccaagatttattcaagacatggcaggatcctgcaagggggactgtttctggtggcatgattaaggagctcttaatatctttccgacgagccactggacagaagccacagcgcattatattctacagagatggtgtcagcgaaggccagttctatcaagttctattatatgaacttgatgctattcgtaaggcatgtgcctcattggagccaaattatcagcctcctgttacatttgttgtggtgcaaaaaaggcatcatacaaggttgtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacaagtttacagctgatgcattacagtcccttacaaataacctttgctatacatatgcaaggtgcacacgatcagtgtcgattgttccccctgcgtactacgcacatcttgctgcattccgagctcgcttttatatggaaccagaaacatcagacagtggatcaatgacaagtggcacagctgcagggcgtggaggtggagctgcagctgctggtgggcgtagcacaagaggacctggtgctagtgctgccgtcagacctctgcctgccctcaaggaaaatgtcaagcgtgttatgttctactgttaagggagtgcttgtattttgagcatctattttgttgggctttgcttattggtatttcgaacaatatctagtttgtttggtgttgcgtggattattgaactaaacttgttgaactttggtgttaaaactatgttaattttatgattatcgctgtg

SEQ ID NO: 15873 - DNA, 884 bp, Gossypium hirsutum
  Predicted polypeptide sequence is orthologous to G1146
actgtctaggccattgtcggattccgatcgtgtgaagattaagaaggcgcttagaggagtcaaagtagaggtgacacatagagggaatgtacgaagaaaataccgtgtttcaggattgacttctcagcctactagagaactagtgtttccggttgacgataactctacaatgaagtctgttgttgaatacttccaagagatgtatagcttcacaattcagcatacgcatctaccttgccttcaagttggaaaccagaagaaggcaaattatttacctatggaggcatgcaaaatcgtggagggacagagatatacgaaaagattgaatgagaggcaaattactgctctcttgaaagtcacatgccaaagaccgagggatcgagaaaatgacattttgcagacggttcaacataatgcttatgatcaagatccttacgcaaaggagtttggaatcaaaattagtgaaaaactcgcttcggtcgaggctcgtatccttcctgccccttggctgaaatatcatgaaactggaaaagaaaaggattgtttgcctcaagtggggcaatggaacatgatgaacaagaaaatgattaacggaatgactgtgagccgatgggcatgtattaacttctcacgaagcgtgcaagagagtgttgctcgagggttttgcaatgaacttgctcaaatgtgccaagtttctggcatggagttcaatcccgaacctgttataccgatctacactgccaggcccgagcaagtggaaaaagctttgaagcatgtttatcatgcatccatgaaaactaagggaaaagaactagagcttctattagctatattgcctgacaacaacggctcgctttatgggtgatctcaagcgaatttgtgaa

SEQ ID NO: 15874 - DNA, 682 bp, Gossypium hirsutum
  Predicted polypeptide sequence is orthologous to G1146
tactcgctttttccctactgatcgcaacaaaactgataggagtggcaacatattaccaggtactgttgtggatactagcatctgtcatccaactgagtttgatttttatctcaatagtcatgctggaatccaggggacaagcaagcccacacattaccacgttttgttggatgaaaatggcttcactgctgacatcttgcaagtgctcacaaacaatttatgttacacgtatgcgaggtgtaccaagtccgtttccatagttcctccggcatactatgctcacctcgctgcttatagggcacgctgttatattgaggatgagatgtcggatagtgggtctactggtggaggccgaaagccgaaagaccaggttgtagaggttaggccgctgcccagcataaaggataatgtgaaggaagtgatgttctacgtctgattaattatgtttggttgattgtgggaagttgcgcaagtatagttgcacggtttgtggaatgatggtggagtcttatttattccattggtggacttagtaatcatctaattttggagtttttgttttggtggttgggcgacttgttgtgtgaagtttgaattattataaatcacacactgtttgtggattacgaaaatttcataaatgtcctttatttttaaaaaaaaaaaaaaaaaaaaaaaaaaa

SEQ ID NO: 15875 - DNA, 484 bp, Gossypium hirsutum
  Predicted polypeptide sequence is orthologous to G1146
cagcctaccgagctcgattctacattgaacctgaaggttccgaaaccgctaaatcacgtcgtacacgcacaaccaatggttcaccggttcggcctttaccagcattaaaagataaagtgaagaacgtgatgttttactgttaaaaaacatcgaagggaaagagtaaccaaaaaaaacatatatgtacatgctttgttgtgttcacagtgtagagagactgccacatccctgactttttgaaagcgcaacaaacaaccgactgtaacagttactagcagactaacaaaaaaaaaaaaaacctcagctttttagagcatatataatctaaatgcatatacgtatatgtatatgtatgtgatacgagatttctaagctgaaaattcaacaacatttaatattactggtccgagagacacaacaaaacaactgttgaacaaaaacgatatatagctgtctttcaatccaaaaaaaaaaaaaaaaaaaa

SEQ ID NO: 15876 - DNA, 556 bp, Gossypium hirsutum
  Predicted polypeptide sequence is orthologous to G1146
cgcactaccatgttctttggggatgaaaacaattttacagcagacggaatacagtctctaacaaacaacctttgttacacatatgcaaggtgtacgcgctcagtctcagttgttcctcctgcatattatgcacatttagctgcattccgtgcacggttctacatggaaccagagatgcaagagaatgggttgaacagctgcagtaatggtcaagcgaaaggtacaagggcagtgggagaatcgggggtgcggccattgccagccttgaaggagaatgtgaagagagtgatgttctactgttagaatggatgagtggagtgggagatttgcaaccatgaatagaataacttttttcagcttattaaaatttccttgtacagtttaaatgaatgattgcaaagtcttccaaagtttagtttaagataaaaatgtgaaacgtgggaggaatgatccacagatgcaagaattgttaaaactaggttattatcttcatgtaaagaaatgctaatttagaatccttaatcatcttattctcaatttaaaaaaaaaaaaaaaa

SEQ ID NO: 15877 - DNA, 270 bp, Gossypium hirsutum
  Predicted polypeptide sequence is orthologous to G1150
cctgcgaaccgaagatcattgatatgatattttgatttaaatagtccagtcttctcaatcactaaacagaatttagagcataacattaagagtagtttaaagagggggatgggggaaatgactcctaagcgcttccatttgacttaaaacttattattacaacactaactgttacatttttggctcaattattgattgctcattcccaccgccactatctcctcatactctatctcaccctaaaccaaacataatatataaatttgactt

SEQ ID NO: 15878 - DNA, 572 bp, Gossypium hirsutum
  Predicted polypeptide sequence is orthologous to G1181, G1850
caacggtgctgtcgccgtctttcactctcttacggtgttgaaacccgtttggattcaacgatcttatcgcatgacggacctggtttcttgtttggttactgagaaaattttcgttgccttttaagagcgttattattctttcgcttacgtttgatgtaaaaggaacgccaaagtgatctgtctccctctctctagagagttcggatctagaaacgaaccgtatggcaccattgccggccgatcaaccctgcgaatctcatgccagcggtgctgtggctgactcgcaacggtctttacctactccgttcctttctaaaacctatcagctcgtcgataattcatccgtcgatgatttgatttcatggaacgacgatggatcaactttcatagtttggcgcccagctgagtttgctcgtgatttgctccctaagtacttcaaacataacaatttctctagcttcgttcgtcaactcaatacatatggatttaggaaggtagtgcctgataaatgggagttcgctaacgattgtttcaaaagaggtgaaaaaggacttctccgagacatacagcgc

SEQ ID NO: 15879 - DNA, 906 bp, Gossypium hirsutum
  Predicted polypeptide sequence is orthologous to G1181, G1850
gcggccgcgtctacctgatagatgggagttcgctaacgattgtttcaaaagaggtgaaaaaggacttctccgagacatacagcgccggaaaataactcataatgcttctggttcggcgacggtgaccatcgcgccggttacttgtaagccatcgccgtcgaattcgagcgatgagcaggttatttcatcgaactcgcctcctgttgctaccgttttgaatcggaccacaagctgcacgacaacggcggagcttttggaggaaaacgagaggcttagaaaagaaaacatgcagcttaaccatgagttaactcagttgaagaggctgtgtaacaatattttaaatttgatgactaattatgcttccggtcaagtggagaaccattcaaacttggctgaagggaaggcattggatcttttgccagcgaggacgaggaacggtggtggttcgaagcctgtcctggcggagacggaggaggaagcagcggaggatttgaggccgaagttgtttggagtttcaatagggatgaagcgcgtgaggagagaaggtgaggaagaggaaggggtgatggatgaggagcagcagcaggagattaagcctggatctgacattaaatcagagccgttggatggcaataatgataatcaggactccacgtgtctggagcttggcaaatgatcgaatgggatttattattattatttatttgattttcttttaatcagtggatggcgatgttgatgatgagaatcggaaaggaacgcgccaacgtggtccctatggagcatgtttcgaagaatcacgtgttgggaaaacagacacgtggcgccatgtgaaatatttgttctggatgcttctagaatgtaaagcccacagacgacagaacatgtaaaatagactaaacgtgg

SEQ ID NO: 15880 - DNA, 954 bp, Gossypium hirsutum
  Predicted polypeptide sequence is orthologous to G1181, G1850
ctgatcatcactcttcccatccaacggctctgctttaaccccgggctcacactctatgtcctgctgttgttcttgattattattctgctcctccaccgaatcctctctcctcacgcgcttcatcccaatcgaaactccgaacaatttcggcgtcacatcctcctccatatccaccgcctccttcggacccacgcctcccgctttcgtacccgaattcttccccggcaaaagatccaacgccttaccttcggctgaatttgaattattttccgactgaccggaagcatagttcgtcatcaaagttagtatattgttgcacaatcccttcaactgagtcaactcgtggttcagctgcatgttctcttttctgagcctctcgttctcctctaaaagctctggcgtcgtgctgctggtggttcggtgcaaaacggtggcaacaggtggcgagttggacgaaatgacctgctcatcgcctgaattggatggggaaaccttgcaaggaatcgccgccacggtcaccgtcgcggcaggagcagtagtggtaggagtcattttccgacgttgtatgtctcggagaagacctttctcacctcttcggaaacaatcgttagcgaactcccatcgatccggcactaccttcctgaatccctaaaaaagataaaaagcaaaataacctgtctaaatcaactaattataatcgaaaacttatctctctctatacgactgatagtaattatagtattcaaatctacactttttcccacttacatatgtgttgagctggcgcacgaagctagagaagttgttatgtttgaagtatttagggagcaaatcacgggcgaattcagcggggcgccaaacaatgaatgttgatccatcttcgttccatgaaatcatgtcattaacggagggatcgtcgacgagttgataggttttggtaaggaacggagtagg

SEQ ID NO: 15881 - DNA, 831 bp, Gossypium hirsutum
  Predicted polypeptide sequence is orthologous to G1181, G1850
ctggtttcttctttggttactgagaaaattttcgttgccttttaaggtacggaatttatttgaacaattttgagtttttttaatggaatttaatctctatgctcatgtatggatgtttataatatttgttcataaagaaagcaagaaatcttttaatattattctgaaactgtctccgtttctgtgcttttgaataatctatataaaatttgatgttgaatttggtgaacttaaaaagatattttcagctctatgcatggaagatatttttttgtttcatttgtttattttctttttctaacactctctcggctgccaatcagagcgttattattctttcgcttacgtttgatgtaaaggaacgccaaagtgacctgtctccctctctctagagagttcggttttgtgtaaggttcggatctagaaccgaaccgtatggcaccattgccggccgatcaaccctgcgaatctcatgccagcggtgctgtggctgactcgcaacggtctttacctacaccgttcctttctaaaacctatcagctcgtcgataatccatccgtcgatgatttgatttcatggaacgacgatggatcaactttcatagtttggcgcccagctgagtttgctcgtgatttgctccctaagtacttcaaacataacaatttctctagcttcgttcgtcaactcaatacatatgtaagtgtttaaaaatttgaacgtgatagtactaataattagttttaattcaacttaattttattttttcttagggatttaggaaggtagtgcctgatagatgggagttcgctaacgattgtttcaaaagaggtg

SEQ ID NO: 15882 - DNA, 928 bp, Gossypium hirsutum
  Predicted polypeptide sequence is orthologous to G1181, G1850
aatcatcataaaatttgaactttctagaatttaacaatcagatttctcatctctggtgaacgaagcaaacaccttctttaaggaattattaattgttgtctctgatggctccgccgccggtggagcaaaacggagatgcaacgacgggaacggcggaatcacaaaggtctatacctacaccgttcttgactaaaacgtatcaattggttgatgatcacacgattgacgacgtgatttcgtggaacgacgacggatctacttttatcgtttggaatcccacggtgtttgctcgtgatttgcttcctaaatatttcaagcataacaatttctctagttttgttcgtcaactcaatacttatggatttagaaaagtggtgcccgatcgatgggaattctctaacgattattttcgacgaggtgaaaagcgacttttgtgcgaaatccagcggcggaagttgtcgtcgccaacagcagcagctgttacggtggctccggtgacggttgcggcgattccaatggcgaagcctattatatcaccgtcgaattctggagacgagcaatctccagtcatttcatcggcctcatcgccttcaaggctgaaccaagcaggaaccgttatggccgagctcatgaaagaaaacgaaaaattgaggaaagagaacgtgcagcttaacaaacaattatcagagatgaagagtttgtgcaataatatattcagtttgatgtcgaattacgcaagttctcagtcggagaacatttctccggtgcacaaaccgctagatttcttgccggcgaagcggttatcatgcggagaatcagtcgaagaagaacgagtccgagtattcggcgtcctatagagagcgcaaagcgcgcaggaagagagagcgtagcgacggagcgcgacgcagcagacgaacgcatacactgc

SEQ ID NO: 15883 - DNA, 640 bp, Gossypium hirsutum
  misc_feature (617)..(617): n is a, c, g, or t
  Predicted polypeptide sequence is orthologous to G1190
cacagctgagagccacaggtgtgacatgaagtatgtgctgttggagatggaccgaatcctgcgacccaaggggtacgcattaatacgggaatcaagctattttattgatgcaatagccagcattgccaagggattgaggtggagctgccatagagaagacaccgaatatggtgtagcgaaggagaagttattagtttgccagaaaaagctctggtattccgctagcagcagttcaagatgacaatatatgtcttgcctggttaagttaaaaagtactatataatataatattattgttcttccaagcgtaacgttggagctgaaaagatggaagttgcatacggatacaagcatatccatagaaatcaaagagcctctaaattcatattcgtccattgaagggttagcctccccccaataatagttgattttatagatatatattctttgtaaggcatctatctattctatacacagatttttaatttttttttctatatatattttgtgggccttattttctttctatatgttgtcagtttgggatggctgtggaaatattattattttgtcacttccttcccagttgtgatttttcaagtgtaatgaaaactctntctgctttctaaaaaaaaaaaaa

SEQ ID NO: 15884 - DNA, 567 bp, Gossypium hirsutum
  Predicted polypeptide sequence is orthologous to G1206
ttttttttttttttttttttttttttaagcaaacagaagcaggtatattgtctaatattcatattcaattttttgttcccacatgcatgatatgcatatggtaaatttgggattttacatgtctgacaaaaggaaactgctaactagtcctttgccccataagtatttgcagtcagcaatatcaggcaacaaatgaaccattgttttccagacattatcagatgactttcagatcttatagataaggcccataacccaaagaaacattgttcactgcaacaaaagatgttggcataataatggaagttcctcaaagtcctctgatctgacgtaaagtttctaataatgcaacattaaatatttacagaaaggaggaaaaatgttagcccatataccacatcagacatattgcagtgaagcttggttacagagtctccccgcccaagctcttgagctactccatatgcaagatgtaactctggccccatctctagcttaggaagtacctctgataatttggtatcaaggttaaggccacaatgagagagcgtgtattccttctcgtgc

SEQ ID NO: 15885 - DNA, 550 bp, Gossypium hirsutum
  Predicted polypeptide sequence is orthologous to G1206
aacccaagctaaatcaattaaatccaatcaggtgattctaatccccaagaaaacaccagaatagttcaaagaaatacagagtattgtgctagcctttatcatttagcaggagccaagaaggaattaggagtttatacatacatacatacatacatacatacatacatacatacatacatacagacatatgtatatgtgttacatcttcttgacactgtcaataaatccaatcagtcagtgatgttggaaaaaacagaagccgttgcccacttcgcaattgtaatcgttcagaaaggatgcaactcaattaactttataagcaagttcaacctctgcatttggatccaagtatttcacagcttgctggactgcatgtacagtcattttcttcacctctagtttatcctctttttccctatgatcacggggaagcagacgaaattcctcagtcaagcgaacacactcaccgacattttcaggcgaaacaaaatcgagagcaacctttatgcatgacttaatgttccggacttgatgaggacaaccagcaggt

SEQ ID NO: 15886 - DNA, 982 bp, Gossypium hirsutum
  Predicted polypeptide sequence is orthologous to G1228
atttattacttgtattgatttgttagcttcaatatatggaatgttggtaactgagagagggacacagaaggagaaaaagaaagaatttaaggcatttacttcaactactgctaagctgttatggagaggctccaaggacccattaatccttatgaaaatactaacctctgctactgcactactgcttcttcttactctttcaacattctactctcattctgctttcattctctctttagatgctgagagagactgaaccatgtgccctccacccaattaaatgatattttccttttcaaatatctttacatggagagcatttggaggtggaatgcttagaacaaggttttattagctgtgagagattaaagcttggagaagaagaagaagaagcacacttttcaataccaagctttgaagagaaaatgccattccttcagatgcttcagagcgtggagtctcctcagctttttgcctttaaagaacccaacttccagacacttttgagactgcaacacatgaagccttgggagctaaacaacaatcctttcattcctgaaatggaaacccaagttcaagccctagagctggaaagttgtgtcacccatgaaacagtactcgacttacattcaccagtcaaatccgagaccaaagagcttaagaaaagcccaccttcaagctcatgcgttgaagttctcagctctaggtctaaccaacaccaaccaaagtctgacaattgtagcagagaacccaacttgggctcctcgcctcagaagattttcacaaagtcccctccgattactagagaacgaagaaagcgaaaacgaacgaaggcagccaagaataaagaagaagttgaaagccaacgcatgacccacattgccgttgaacgaaaccgtagacgtcaaatgaacgattatctaaattctctccgctctctcatgcctccatgttatatccaaagaggtgaccaagcgtcaat

SEQ ID NO: 15887 - DNA, 571 bp, Gossypium hirsutum
  Predicted polypeptide sequence is orthologous to G1242
tgaatcgcggacaactcaagagctgctcggagatgtgatacctcatccgattggttgagaaggaaaaccaagaatgtgacgagagggagcgacaagcccgcaaggaaaagaaacttgccaagaacataacaccatcgaagcgcggagggaggcagccaactgagagtcctactcaacaaaagaaacgcaagcagctatcaatggatgattatgcgaactcgggtaaaaagaggaagtgagcgagtaatgtgaactacaaattttgggtctaaaagctctgatatttatttgggtttaaaagcagaaatatcagaacgaggaattgggctgtagtttgcatttggtatttcatggaactcttgaggttgggtgggaattaaccaccattaatggaagttagtttaggttataaaaggtgtataaatgagtatagtaagtttaatcacaagggatttttaagaacaatctattcttacccgtctggatttggaaccatatgtattatgctgaccattattactgaaattatattggagccggatacgattatgaccaaaaaaaaaaaaaaaaa

SEQ ID NO: 15888 - DNA, 835 bp, Gossypium hirsutum
  Predicted polypeptide sequence is orthologous to G1272
gcggccgcttcgaccaaaagagcaaaccattgaccatatttatcacagtataaaaccaaacaggaaaaagccacaaaagccactgcagaagtgagcttagctagacaaccgttcataagttcagataacatacggaacacctaagagtgttgcaacccaaaagtctaaagacatgaaaaagcagcataaatagtttttggtagccaaaatccaaaagccctatacaaaaacatggttcaacggttttcagcagaagaacatggagctgctgacattatccttcaacctgggaagctgaggtacagaaatggctcccggagcagtcaccccaccatggctcgatgatgtctctgaagcatcctcaaacttcataaattgccccaactgtgaagctgccaaatgagcgtagcaaataggggccacaacagatatggctgtggtgctcctttgatacacgtaggatagagaatgaacaagctcctgcagatcatcagctgaaaacccaacctggtctaagagaacatgatagtgggtcggccttgtggtccctatcattccagcatgagcacaaaggtaaaaatcattgttcttcggatggcatactttgttgtcaattacagtaccaggtaaaacattgtcaggagatccctgctggaaaaacttggtatgatggtttttttgtgcaacaataaccacaaacttagggttccaattctcgtcaaggaacttgcaagcctcaataacttgatcaagttctttgttcaaaacttgattgaactgagactcgctaaccccatccctgaaaataatgatctgatcaggcttcctcttccct

SEQ ID NO: 15889 - DNA, 969 bp, Gossypium hirsutum
  Predicted polypeptide sequence is orthologous to G1272
cttgaggatgttacatctaacagaaacaacgggaatgcaagccctgatgtccatgatgactcaaatgggcaagacaggaagaggattaaacggccttatcagtcaaagacctttaaagtggagatcagctttgctgcaaagattcccatgcaagccattcaaaatgctctgcgtggacaggaatcagaaaactcacaagaagccctaagggtgttggatatcattttacggcagcatgctgcaaaacagggatgtctacttgttcgccagtcattctttcaaaataatcctgataattttacagacattggaggtggtgtcctaggctgcaggggtttccattctagcttcagagcctctcaagggggcctttccctgaatattgatgtctcaactaccatgataattcgtcctggtccggttgtggactttttgcttgccaatcagaatgccagagatccgtactccctggactggaccaaggctaaacgaagccttaagaacctgaggataaaagtcagtccatccaatcaggagtacaagatcactggattgagcgagcagttgtgcaaagatcagttgttttcattgaagcagaaaagcatgaagaatgataatggtgaagctgagaatctacagattactgtctatgattattttgtcaaccatcgcaacatacagttgcgctattctgcagacctgccatgcattaatgtcggaaagccaaaacggccgacatatattcctttggagctctgttccctggtgtctttgcaacgttacaccaaagcgctaaccactttccagagagcttctttggttgaaaaatcaagacagaagcctcacgaaagaatgacagtcttatccagtgctttacagagaagcaactatggtgctgagccaatgctgcgttcttgtggtgtttctatcagcactaatttcacccaagtcgaaggtcgtgttctgcca

SEQ ID NO: 15890 - DNA, 856 bp, Gossypium hirsutum
  Predicted polypeptide sequence is orthologous to G1330, G2423
gtttaccctcagttcttccccacagaaagtaacctattctcacaaatggatgtttacgagagcggtttcatatctgaaatgactccacaaagtaaagaagatatggatgtaaggaaaggtccatggactgaagaagaagactacatgctcaaaacttatgtcaatgttcatggcgaaggtagctggaactcagttgctcgcttatcaggattgaaaagaagtggaaaaagctgcagattaagatggctgaactacttgagaccagaagtgatacgtgggaacataagtctccaagagcagcttttgattcttcaactccattctcgatggggcaacagatggtcaaaaattgcacaacaattacccgggaggacagacaatgagataaagaactattggagaaccagggtcctaaaacaggcaaaacagcttaaatgcgacgttaacagccaagaattcagggacaccgtgcgttgcgtttggattcctcgtctgattgaacggatctgtgcttcatccggatccccctcggctcaaccctccaccacctatgaaaagacgagtgtcctgcccgagttatcaggcacttcatcagactcccaggacgcccaactctcttccgtttcagacctcacagattgttacaacccaccaagcaattcaaactacccgaatagcttacagaacgggtgggggtttatggtcggaaaatttaggcggcacttggaatattcaggcgacggaggtgaagagtcgatggagagtgtgtggaacgaagagaatatttggttcctaagacagcagctttatgatgacaagatgatatgattagtttacgtgtgaggtatcaagttta

SEQ ID NO: 15891 - DNA, 1033 bp, Gossypium hirsutum
  Predicted polypeptide sequence is orthologous to G1330, G2423
gtatactcgtaagctatcttcatcacaaattcaattctcaaatcagcttagaggtttatccttgcctctccgactgtaattaacctgttttaagttgagaaatggatgtttacaagagaggtttcatatctgaaacttcaagaagtgaagaagagatggaggctaaggaaaggtccatggactgaagaagaggactccatgcttagggcgtatgtcaatatccacggcgaaggtcgctggaacgctgttgctcgcttatcaggattgagaagaaccggtaaaagctgcagattgagatggctgaactatatgcgaccagaaatcaaacgaggaaacatcagcctcgaagagcagctattgattcttgaactccattctcgctgggggaacaggtggtcgaaaattgcacaacacttgcctggaagaacagacaatgaaataaagaattattggagaacaagagtccagaagcaggccaagcagcttaactgtgacgttaacagcaaacaattcaaggacgccatgcgttacgtttggatcccccgtttagttgaacggatccgtgcttcatccgagtctccctcgagtcaaccttctaccaccaccaacaccacctacaatgatcgtatcagcaacataagcagcagtcaaatgagctacgcaaatgcgagtgggtcggtccaggttgacccaagtcttctgcccgaattatcaggcacgtcatcagactcccttgacacccaagtctcttccgtttcggacctgaccgattgttacaatccacaaagcctttcaaactacttacacaaggggttaggtttggaaaaggagggagcggccacatggggcagagatgaagaattccaggcgacagaggagcatagcaatggttggttggttggtggtggggagtcatcgatggacactgtgtggaatgaagagaatgtttggtttttacagcagcagcttcatgatgatgggatctaaccacatgaattcgtaatcgtaatcatgtcatgtcatagctgtttcc

SEQ ID NO: 15892 - DNA, 934 bp, Gossypium hirsutum
  Predicted polypeptide sequence is orthologous to G1340
tgcacttgatgatggatgaccaaggcggtaacaatgctgtaactagggaatacaggaaagggaactggactgttaacgaaacaatggtgttgattgaggctaaagagatggattatgagagaaggatgaagagaagtggggatcacagtgaagggtggaacaaaccgacagagttgagatggaaatgggtggaagattattgttggggaaaagggtgtttgaggagccaaaaccagtgcaatgacaagtgggataatctcatgagggactacaagaaagtaagagagtaccaaaggaaagtagctgagagagaagggaatgatagtaaggaaagatcatattgggagatggagaagaatgaaagaaaagaaaagaacttgcctagtaacatgttatgccagatatatgaccgtttggaggaggtggtggagaagaaaggagctcaaacggtggccgctacggctggtggtggtggaggctcagatcccaatattcccaacatatcgtatgttatggatagaccaatggttagtacttttcaaccttcattacctcctcttttacaacatcaactttcagctcctatatctgctgcaattccattacctctaccacaaggatcaccacagctgccgccgccaccagcaccaataatacaaccaccacctctttcatttgctcagccactgcccaccatagctcagattctgatacaagtgagcattcagactcaccagcaaagagaaggagaagaggtggtggcaatggtgaaggcaccagtgggactctctaacaacacaaaggaagtaagcactgcaatctccagaagtgcttccattatagcagaagccatccaagctagtgaagaaagagaagagaggcgacatagagatctcttaagcttccatgaaagaagactaaagattgaagaatc

SEQ ID NO: 15893 - DNA, 973 bp, Gossypium hirsutum
  Predicted polypeptide sequence is orthologous to G1341
ccattcgcacaagcagccactactgcttctcgttcagtcactgaagaagagtgggaagctgctacttctacatccgaaacggctgtcaccgccgttactggagctgcaaaagcggtaacgccgccttcgagtggtagtgagctagccatggttgtttgtaggaacagtaaagaactagtggagattgttaaagaagttgatgaatatttccttaaagctgctgatgccggtagccatctttcattactgttagaagcttcaaatcccaatctttcaggcaaagggtataataactatgcctgtaacttaaccccaacaacatggacatggaattggagccccaaaatagtggaaaacaccattgttggacatacaggaaatactagccattgttccaccatagagaggttatatgcttgggagaagaaactataccaggaagtcaagattgatgtgcatgtggagaagcatgtatgagatccaccaagttcacacacacatagttcaacaactcaagtaccttaatttcatcccttctaacgagccgacatccgagattcaccggcaatcaactctccagctcgaactcgaagtccagcaatggcatttgtctttctgcaacttagtcaaagctcaacgagactacattcagtcccttgctggttggcttcggcttagccttttccagttcagcaaaaacccgcttttaagaaacagtcaagaatcgaaaatttactctttttgcgaagagtggcatcttgcagtcgataggattccggataaagtagcgtctgagggaatcaagagcttcttgatggtaatccacgccatcgtagttcaacaagccgaggagtataagcaaaagaagaacgcagattctgcgtttaaagacttagagaagaagcagctgaacttagatcactcgaaagtaagtacagccctttttctgtactggaaacaaacaaagacccca

SEQ ID NO: 15894 - DNA, 2445 bp, Gossypium hirsutum
  Predicted polypeptide sequence is orthologous to G1341
gggattttcatgttcgaagaagctttgtttgctgtgaaagatagtttcttgaagatgaaagaccctccattggtgaaagctgcagtggtaaaagcaatagatctttagactaagtaaaattaactcacagctcattttgtttccctctttactgtttagttgcttcaaattttagaaaaaaaaagttgatctgtggcagaagggtgaagcaagaaaaaaaatggggtgttggtactcaaggatcgatagggaagagattgtttcgcgttgcaaggcgagaaagagatacatgaaacagttagttaaagcaagacaaactcttggtgcttcacattctatgtatctacgctctttacgaggcacaggctcagctcttcttcagttttccagcaatgaaactactacccactcccaccaccatactactccgccgcctcaacagccggcattgccgccgccaatgagtcctagttcagacacttggacatctgctaacacggcctcccctgttctgccgccgccttctcctcctcaatccagtaactgggacttttgggatccatttgttccagctacagagtcacggtcagccacagaggaggaatgggaggcttccacgtcagtgcctgaggtggcggtcaccgctacaaaccccacgaccagggctgcaagcatggcaccgcccccttctgtggtgagtgggttctcgaaagatacgggaagtgagcttgctatggtggtgtcgaggaatagtaaagaactggtggagatcgtgaaagaggtcgatgagtattttattaaagctgctgatgctggtagccagctctcgttgctgttagaagtttcaaattccaattttcctgctcaaagtaaaatgagttatttctctctcattcttttccttttctttttccctcttaacatttctgggtggggttttttttttttccttgttgcaggtaaagtgtataactatggttgtaatctgactccaacaacttgggcatggaatcgaaattcaaaaatggaaggaactgggaagttgggaggcgataggacgggagaaaatggaaatgtaggtggtactattcttaacagtagccattcttctactatagagagattgtatgcttgggagaagaaattatacgaagaggtcaagactgtggagactataaggatggaacatgagaagcgggtggcccaattgaggaagctggagttgaagagagctgactatgtcaagaatgaaaagactaagaaagaggttgaaaaattagaatcccaaatgatggtttcttcacaggccattgagaccatatcagcggaaatcatcaaactgagagaggcagagctttatcctcaactcctggaccttgtaaacgggttgatgtggatgtggagaagcatgtacgaaattcaccaagttcacacacacatagttcagcagctcaagtaccttaactttatgccttctaacgagccaacatctgagattcacaagcaatcaactctccagctcgagcttgaagtccagcagtggcattcttctttctgcaacttagtcaaggctcaacgagactacattcagtccctagcaggttggctccggcttagccttttccagttcagcaaagacccacttttaagaaacaatgaggaatcgaaaatttactctttttgtgaagaatggcatcttgcaattgacagaattccagataaggtagcgtctgaaggaatcaagagcttcttgacagtaatccatgccatcgtggtccagcaagcagaagagtataagcaaaaaaagaaggcagattctgctttgaaagattttgagaagaaggcagcagaacttagatcactggaaagtaagtatggcccattttcctccatgcctgaaatgaacaagtaccctgttgtagaaaaacgaacaaaggtggaaatgttgagagcaaaggctgaagaggagaagaataaacatgagaagtcagcgagtgtaacaagagcaatgactttaaacaacctccaaatggggtttcctcatgtcttccaggcaatggtaggatattcaagtgtatgtatgcaagcatttgaatctgtctacaatcaagccaacggtattgatcaggaacatgatgtgaagagaatacttccttgagaaaagactaacactctggaatcaaaatgatgctaccactgatacgtgttcggtattgggatcaaagtccagacacggaagaaaattccagtcaagtaggagtgtagaattgtataccttgttttatttcgtcattggaaagtgttgaatgctttgcaagtttctgtttaaaacccttttttgtttgccttttgaatcatgaaattatgttttggtaatgaattgctctgagagcaaccaagtgaagcacttgtattgcttgagattaaaaaaaaaaaaaaaaaaaa

SEQ ID NO: 15895 - DNA, 916 bp, Gossypium hirsutum
  Predicted polypeptide sequence is orthologous to G1380
ttcgttttggttgggttgattatttcctcacttcccttcttttttgtttcatcgtgatcttttcatcaaccccttttgtttgtcatatagattgttgctattcttttaatcttttaaatattttttttccatgaggagagggagaggtgccgcagcggcggctcctgccgccgcggcaaacgccgtagctaggagaccggcactgcaacccggcggatctattaaagagccgagatacagaggtgttagaaaaaggccatggggcagattcgcggccgagattcgagacccctggaagaagaccagggtctggttagggacgttcgactcagccgaagaagccgctcgagcctacgatacggcggcgaggacactccgtggacccaaagctaaaacaaatttccccataaattcttcaaatatcccggcttttcctttcgaaaccaatcatcaccacaacgaagggttcatcgaccaacgccggttatatccgatgggcgattttcatgaccccgaagtgaatccacagagacccacgaggagtagcatgagtagcacggtggaatcgtttagtggacccagaccggtccaaccaccgcaaaaatcggcggacttcgcggtggtttcgactaggaagtactatccgaggccgccgccagtagagccagaggattgtcatagtgactgtgattcatcatcgtcggtggttgatgatggggatatcgcgttgtcttcgtgtcggaaaactttgcctttcgatctcaattttccacccttggatgaagatgaagatctccagtgtaccgctttatgtctttgatcacgatgccggtgatgaatgatgatgatcgattattggatctctttttcttttttaaaaaatgttagctttttttaagcggaaaaaaaagatgag

SEQ ID NO: 15896 - DNA, 954 bp, Gossypium hirsutum
  Predicted polypeptide sequence is orthologous to G1380
cctccccctcctaccttggtgccatccagttcccatcccacacctatctccttcttcttcaaattgtttttcccagttattttgtttggttttctttgatctctctctctctctctctttcatcttcaatctttttcttttcttttcttttttaaatttatataaaatttatgaatatattagttttggtttgggttgatttagtcagtttacttccttttttatttataatctttttttcatcatcaatctcctttgtatttctataacatttattaccatttatttaatattttgagcttatacacttgattttcgattacccttttgtgagattcgaaaaaaaaaacccatttttttacttattttccgatgaggagagggaggggtcccgccgccgccgtcatccccgatggagaagaacccaaatactgaggtgttcggaaaagaccatggggtagattcgcagctgagatccgagacccgtggaaaaaaaccagggtttggttaggtactttcgattccgccgaagaagcggctcgagcttacgatacggcggcgatgacactgcgtggaccgaaagccaaaacgaatttcccaatcaatccctcgaatattaccgcttttccgatcgatcaccaccaccgtcggttatacctgatgggtaattttcaagacccgaaaatgaacccacaaagaccgacgaggagcagtatgagtagtacggtggagtcttttagtggaccaagaccaacccaaccgccgctggaatcagttgtgtcggaccggaaacattatcatcatcggaaaccgccggtgttgccagaggattttcacagtgactgtgattcatcatcgtcggttgtcgtcgacgatggggatatggcttcttctccatgtaagcaaaatcaaacattgatgccttttgatctcaaatttccaccgttggatgaa

SEQ ID NO: 15897 - DNA, 1030 bp, Gossypium hirsutum
  Predicted polypeptide sequence is orthologous to G1380
attgatataacaattttgcttttctttcaatctttgaaatttaaaagatctgatttttcattacctttttgagagaattggttgaagacttaacttccgattatttccgatgaggaaaggaagaggagccaccgcggctgccgatgcagcgatgaaaccggcggtagaagccaacggatcggtcaaagaactaaggtacagaggtgttaggaaaagaccatggggaagatttgcagcggagattagagatcccttgaaaaaaactagggtttggctagggaccttcgattcggccgaagaagctgctcgagcctatgatgcggcggcgattaccttccgtggaaacaaagcgaaaacgaatttcccttttaattcctccgatttccctgctttcggaatagatcgtcatcatcgtcggaacaacgaaggatttatcgccgacggccaccggtttcatcagacgggcggcgattatgaagatccggaagtgaacccgcagagaccggcgaggagtagcatgagtagcacggtggagtcgtttagtggtccgagacctacccaaccaccgcgaaaaccatcagatttcgaggcggtttcgacgaggaaataccatcccaagatgccgcggatggcgccggaggattgtcgtagtgactgtgattcgtcgtcgtcggttgtcgatgacggggatgacgataacgtgtcgtcttcgcgtcggaaaatcttgcctttcgatctcaattttccaccgttggatgaagtcgatgatctcaccttatctctctgatcagcggtaacgatcaatttatcaaatccttatgatttaagatgaaatagtacgatttcccttcgctatttatcaaatgataaagatcattgttgttttagaaatatgatcatgaatttagggttttcgattttcatatctcagtctgattatctgatctttctttcttgtataaaacaatttgtctaattcaatccctcaaaagaaaaaatgggtctttgattctaaaaaaaaaaaaaaaaa

SEQ ID NO: 15898 - DNA, 948 bp, Gossypium hirsutum
  Predicted polypeptide sequence is orthologous to G1382
gttttcctctttgacaatggaggaacaaatactagcttcttcttcagctgctgctgctgctgctgctgcttctgcttctgcttctgctactcagcacgatctatcggcttcagctgcttctagtggagctcgctacaagctggtggctccggctaagctaccgatctcaaggtcggcttgtattacgatcccgcctgggcttagtccttcttcttttttggagtctcctgttcttctttcagatgttaaggcagagccttcaccgactactggttctctcattaagcctcaggcagtgcatggctctgttaattctagtacatattcagtgactgctgcgtgttctaatgcttttgatgaaagaaatccaagctgctttgagtttagaccccatcctagatcaaatctggcacctgcagatttaaaccatcttagaagcgaacaatctctgcagatccaaggtcaattccagactatatcatataattcatcagctttggttaagagcgagatggcaggctcctcaaatgagttgagtctctcggtaccatttcatacagctacttctgtggctagtgcttctgctgaaatcgatgtagacgaattaaaccagagtgggaactcaaatagtgggatgctgtcagggcagactgatcatagagtaagtggctcatccacgatatcagatgatggatacaactggagaaagtatggacagaaacatgttaaaggaagtgaatttccacgcagttattacaaatgtacacatcctaattgtgaagtgaaaaagctatttgagcgatctcatgatggacagattacggagataatatacaaaggtacacatgatcatcctaaacctcaacctagccgccggtattcttctggaaatacaatgtctgtacagaggaaagatttgacaaggtgccacctttgactggtagagat

SEQ ID NO: 15899 - DNA, 780 bp, Gossypium hirsutum
  Predicted polypeptide sequence is orthologous to G1420
ggcaaaaagtgggttctcttaatctgttcaaaaaataaatctccccaaagttaaaaaaagttacataccattaattattaactaaaaccccaacttttttttaccctacacttgttcattagcctcgttcctcgtcttaattggaagcacaatatcttgaagaagcccatggtctctaattaatgaagctgaagaagagccattagggctaaaacatggattcaatggagacaatgaagcatacatatagggttgttctacttcttcttgttgctgatcctggtactgatgatggaccataaatgatggggtcaaaccgatattaccgaaaccgcttcctcgaggctgtaccggacacggatgcgtgtgtttgccttcgtaagtggtgataatgatcgtcgtatcatcgaacgatctctcgactcgtttcttcacaccacatccgctactagtgcaacgataatagcttcttggataagggctgtttttgaccgctttttggccatattttctccatctataaccatcatctaagtgatcaatttcagtctttgtgatgaatgcaaatctaggttccttttgcttttttttggttcttctttttatgttttaactgtttctttgtcttgtcttgttcttcatcatcgccggcgttagtactctgttcattaatattcgcagcttcattcgacaacgacgagatggaagacgagttcggcgttgccggcgggttgtttaaacactctgaaatttccgacacggtggaatacggctgcaatt

SEQ ID NO: 15900 - DNA, 864 bp, Gossypium hirsutum
  Predicted polypeptide sequence is orthologous to G1420
gcaaagataagaactttgggtttcttttgtttcttagataaacaaaaaatatggaggagaatatgtgaaaaagtgtatggagaagaagaaagagaatttaatttccatggcgaatttaaggttttccgatgagaatccgtcggcggtggcagcagcagcagcagcagcagcagcgaccagtttcggtggaagcatctttgacatggcaactggagcaggggcatgtgatggagatactaagtgggggtcttctttaggtttcatggacttgcttggcatccatcaagatttcattgccccttctttattcgattcctttcagccaccaccgattcttccaccaccacctccctcaacatcatctgaaccacttcttcaccaacaactggacacgaagcagcttcaagcccttccatcgccggcctccatcgtgccggaatcttctgaagttttaaacaaccctgcaacaccaaactcttcttccttctcttcttcatctaatgaagctgcaaatgatcatgaaccaaccaaagctgaagatgatgaagaagaagagcaggatcaagacaagacaaagaaacagttgaaacccaaaaagaagaaccaaaaaaggcaaagggaaccgagatttgcgttcatgacaaagagtgaagttgatcacttagatgatggttaccgatggagaaagtatggccaaaaagctgtgaaaaacagcccttttcccaggagctattatcgttgcaccagcgctggctgtggagtgaagaagagagtcgagagatcctccgatgatccctccatcgttgtcaccacttacgaaggccaacacaagcatccctacccgataacccctcgaggaagcat

SEQ ID NO: 15901 - DNA, 781 bp, Gossypium hirsutum
  misc_feature (207)..(207): n is a, c, g, or t
  Predicted polypeptide sequence is orthologous to G1435, G2741
gcacgagcctatctggaatcagatattgcactttgccttttctcttcggtttccttattttccttctaccctcttacttcccaaacagcccccgatttccacgcaaatatttgaaaatctctacagtttttactctttcatttccgatccaaacaatcatctctgaaaagtcatttcttattatttttaaatccctattttcaaggncaaaagcaataaatatgggtcaagaagtgaagatgagggactttgaagctaacggcggagacgatgaagaagcaaccgcaaacgccatcaccaccatcgttgatgacgacgacgacgatgttgaagaaagagttatcgaatgggagatgggattacctaactgcgatgatttaactccattatcccaatccttaatcccgccggaacttgcctccgctttcagcatctcgccggagcctcgtcggaccactgttgatgtcaaccgcgcttctcgcaatactctctcttctctccgctctaccggggcccactcctcaaccaccaataacaataacagtaatagcaatttccgtgatacgatagtggttgaagcggaaggatatgggtcggggtcgggctccggatctgacccgaagaagatgaggaagatggatattgcagaggaagcggattcagcggttaggacgacggagaactcggacgatccgtcggggaggacattgaaacgacagcgtttagtgtggacgccgcagctgcacaagagattcgttgatgtggtggctcatctagggat

SEQ ID NO: 15902 - DNA, 844 bp, Gossypium hirsutum
  Predicted polypeptide sequence is orthologous to G1444
cttttatttctctctcaaagcaaaatctgactttttttctttctcttctctttgccttgtaaagattgattatatcttgctttgctttggtttggtgttttgtttttttttattttattttctcgagagagaaagaaagggaaaatcttatctagcatcgatgaggatcaggaaaagacaggttccgctacctttctcttccatttcaccagtacccctttcatcagatcccaactttaaccgccctccggtagcggtggtgcaactcccgctacggcagcaacaaccatccactccttgctgctttgatcctcactacccttctcaatctgatcatccgatcggccaaccactaccaacccaaccccgtgatggaacaacacatggagaacaactcacgaagaacaaacaagactacttggttttgaagactggaggagaagaagaagtggagaacaataatgataccagggagaaaaatgttttgcgtgcaaaactaggaactgcgtctcctccacagtcgagttcttcccatcatcaagctgttgggagatggggtgagggagaaaaagcatttccattgaagaagagaagagggagcgttgaaacaacaggggacgatgatgatacaataatggcgaaagatacaaataataagcggtcgatgaagagcagtaccagcaagatgaagactaagctgagcaagaaacttgtgcagcagcagcagcaaagcaatggtgaagaacaagagagcaaagacattgcttgcactaatgttgattataataataacaattctagtggtgcaaaaaagagaggtcgaggtggtgcactcatggaaagg

SEQ ID NO: 15903 - DNA, 822 bp, Gossypium hirsutum
  Predicted polypeptide sequence is orthologous to G1451
cacatagtttcatgtagttattgtaacttttattctagctaacaaaaagtgagaatcatacatatggtaggtatttataaattcagtgatttttataaaaagaaaacagaaggagctttaattctggtggaaccatttaagatctaacaatgaatccataagatatggaattcagaaccacacaagattcatgttcttgacattattaacacccatataaactctgcaatatttatgtctaatttctggcaatctgaagtccaaggaagaagagtaacctgctcaccgtggccttgaggaaaatacatcactcgactatcgatcgcaggcaatgaaacaagagagccggcacatgcatgccacaactcagaattcaggcacttgtgctcttcaacttgtgaaaaaggcaaaaacatttgagcataagacataactgaatgaagtttacaaataatctcataaattgagtggtagttgtagatctacaaagcatcttacaaacaaatcctagttcatgaaatggtactaagaaagtattattatgagcagaatggaaaggttttttagtataaaatggatataattgttaacaaaaaacatgtttctagaaaagaaattttctgaacagagtctgcatcaagaacctcatatttcattactaatttgcttacgctgaattagacaaagtgctgaacaagaataaaaacaattgcaaaacatgtcaacggcttaataaatcacccaacagaagagtgaggcaagctcagagcccaccacattggatcaaataatgaccgaggaatttaaatcaagaggcagaag

SEQ ID NO: 15904 - DNA, 731 bp, Gossypium hirsutum
  Predicted polypeptide sequence is orthologous to G1451
catgctagctgggcagttaacaccgcggtcctgggctccgaagtatacccattcagaggtaaatgcctttggtagctctacatcacttccacaagtgtttcctggaaaagatgctgtaatagagccagatattggcaactctggtgcccagaattctgctctttttggtaataacaattcatatggccttctgcttcctacaatgatgcctgctattgcaacatcttcatgtgaagctgatgtgccctcaattccattaggggactcctcattccagaatcctctgtatggttgcatgcaagactcttcagagctgtagagcagagggcaagttgacccaccaaccccaactccaacatttgtcaaggtttataaatcagggtcagtgggacgctcgttagacatctccaggttcagcagttaccatgaactgcgagaggagctggctcagatgtttggaattgaggggaagttggaagaccctttaagatcaggctggcagcctgtatttgtcgacagggagaatgatattcttctccttggagacgacccatgggaggcatttgtgaataatgtttggtacataaagatactttcaccagaggatgtgcagaagatgggcgagcaacgggcagagccttttagccccacaaccccaggtcaaagaatgaatagcaccggcactgacaccggcactggtagactctcatctgttggttcccttgaatact

SEQ ID NO: 15905 - DNA, 521 bp, Gossypium hirsutum
  misc_feature (15)..(15): n is a, c, g, or t
  misc_feature (29)..(29): n is a, c, g, or t
  Predicted polypeptide sequence is orthologous to G1451
cgatattcttctccnttggtgatgacccnatggcaggaattcgtgaacactgtgtggtatatcaagatactatccccacttgaagtacagcaaatggggaaaggtcagaatcctgctacttctattccgaaccaaaggcttaacgccaccaccaccgctaccaccagcagcagcaatggcaaccactgcggtgactacatgagcagacaggacttgagaagttctgttgcatcaatggggtctcttgaatactaaatgaaaatcctcaggactgaataaagtttttgatgaattgaaaatggaaagttgaaggagataaatcattaacgttgtaggtgttatatggtactgttagtaatatgtaagcatatgtattgatacaacatcaatttaagatttacccttactgcctgggacctaggttgatattgaagcttttatgtcaagaccactactgtactgttgggaaaattataagtggaaatatgattctccgactcaaaaaaaaaaaaaaaaaaaaa

SEQ ID NO: 15906 - DNA, 926 bp, Gossypium hirsutum
  Predicted polypeptide sequence is orthologous to G1474
cccttttcttttcaccccgtattgtaatggagcaaggaaggtattggatgtggacaaagaggagacatggtttgacttctcatcatcatcatcatcatcatcatcatcatcatgttgaatcatcaacaaaggagggtgcatattatgattcatgggaagaacaagcttttgcagaagatgcttgtggtactcttggtgggtgtatatggccaccaaggtcatattcttgtagcttctgtgggagagagtttagatcagctcaagctctgggtggtcatatgaatgttcataggagagatagagctaggctaaaacaatcccctccatctccatctcctccccaccatgagcaccatcatcatcagaataacattcaggatccctttttgcctttgggttttccgtgccagcctgatgaggtttgtaactttctttataaccctaaccctaattccaatcatggtactactaaacaggattgtccagggcctcctcttttctcttcaccaaaaccatggtcaaacttgacagctgacagatatggaggagacaagagtccaagaaccctagttgttcgagaaacacacaaagaagacatcactgtcggttgtaagagaaagagaaccgatgatcacacacccaccatgaccttattaccattcttcctcgagccgatttcaattcaaaagcaccatcatcatcacccaccagctgatgaagacaacaacatagatctggaactccggcttggtttaaacgcccagagctgaaaaaacatcagacggtcagttggaagagagaaataagatccatgaatgagagaaagacatttttgagagcacaaagaatgtcactattacaacagattctaatttgaagatcatttgaagaattaaatttatttatttgcgaaaaaaaaaaaaaaa

SEQ ID NO: 15907 - DNA, 694 bp, Gossypium hirsutum
  Predicted polypeptide sequence is orthologous to G1478, G1929
gcttagcgtggtcgcggccgaggtacttttttttttttttttttttttttggaaaaaacaaggctaattatgcattaatgatcaagtcaatctggtttacacaactctgggtgtctaatatatatatatagcttatatgtaataattcaggattctctttcatccataactatatctcagacagactaaaatacccccatcaccaaaagacggagaaaaaaaaatgacaatcaaagaaaaagaaaaggaattttaagcgttgttgaatgctccgtttccatctcaaagttacagtgtcgtctctcagaccaactcaccattgttggtagcagcacctcatgtgaagctcccatgaggtatctctgtgttaaattttgacaagtattgcaaaggaaacacctgatgtgtctttgagccaagaaattagcatcatgaacccatttgtcgcatttcctgcacaggtatgcatcatctgcttgacaatataaggttgccctggagttgcagaactcacacttcaccaaccttgttgaaaccctaggatttgcattaggtgagagtgagacaccctgtttcagacaagaacttgatgtgcttccttgttgtaagcctttgcacatggttggaggatgatggagaaaatttgaatgggaaaaatgggtcccgcgtacctgcccgggcggccgctcgaagc

SEQ ID NO: 15908 - DNA, 946 bp, Gossypium hirsutum
  Predicted polypeptide sequence is orthologous to G1480
tccaaacccaaaatcaaaaacaaacacttcaaaccctccacgtttgatccaagcataatattttttatttccattgctttgatttgattcgcgattatgggaatcgaaataagcggcggcacgatcattccaggaggttggggcgccgccgccatggctgtcgcggctaagacatgcgacggatgtaaatcatcggcggcagctatcttttgtcgtactgattgggtctttttatgcttgaattgtgattccaatttccattccggtcacgggagggtgtctatgtgtgaagtttgcgaacaagctccggcggctgtcacttgtaaagccgacgcggcggctctttgtgtcacttgcgacgccgatatccattcagcgaacccactggctcgccgtcacgaacgtgtacccatcgaacctttctacgactccgctgattccatagtcaaatcttccccttttagcttccttgtgccgacgacagatcataatggtactaattgtaaacaagaaattgaagctaacaaaggggattcgtttttcacagaaatggattcgtttatcgatttcgggtacccgaattcatctcaacatcttcatgatgccgccatggatagcgttgttccagttcaaactccaaaaccaatcattccactgatcaacgatggaaattgtttcgatactttcagctatcaaactcaatcatctctcagtcatagcgtttcatcatcgtcgcttgaagtaggaacagttccagatgggaattaccacgcaacacaagtgggtggttcaatcgatcgagaagctagggttttaaggtacaaagagaagagaaagaacaggaaattcgagaagacaatacgatacgcttcaagaaaggcttacgctgaatcaagaccaagaatcaaaggtcgattcgctaaaagaacagaaacccacaacgatg

SEQ ID NO: 15909 - DNA, 995 bp, Gossypium hirsutum
  Predicted polypeptide sequence is orthologous to G1480
ctgaaaagccttcccaaactcagctcacacccacagaaagagagaggaggagaaaagataacttctagcaaactgggttgttgaaatggcatcgaagttgtgtgactcatgcaaatcagcgacggcgactgttttctgccgggctgactcggcgtttctatgctccaactgtgactccaaaatccacgcagccaacaagctcgcctcgcgtcacgctcgagtttgggtctgtgaagtctgcgagcaagcgcccgctcacgtcacttgcaaggccgatgcagccgctctctgtattacctgcgaccgtgacatccactccgccaaccctcttgctagccgacacgagcgcctccctgtaacccccttctacgactccgtcaattcagtcccagccgtcaaacccaacggagttgttaagtttctggaggagcgttacttctccgacgtggacggagacgctgatgtcagccgggaggaagcggaggcggcgtcgtggctgcttccgaaccctaaccataaggctgtggacagcccggacgtgaactcggggcagtacgtgttctcggagatggacccgtttctggatctagattacgggcatggggatccaaaaatggatgcccaggagcagaacagctccggcaccgatggggtggtccctgtccaaagcaagaatgttcaagctccgtcggctaacgatcactgtttcgacttggacttcaccggatccaaatccttctcttatggctacaaccccaacttcatcagccacagcgtatcatcatcatcattggatgttgggggtagtcccagacggaagtacgatgacggacatatcaaacccgtacggaagagggcctgagtcaacacatcagacggtgcagctatcaccggcggacagagaagcaagggtgctgaggtacagagagaagagaaagaacaggaagttcgagaagacgatccgttacgcctccagaaaagcatacgcggagatg

SEQ ID NO: 15910 - DNA, 819 bp, Gossypium hirsutum
  Predicted polypeptide sequence is orthologous to G1481
tttgtttaagatgataatgcactaattcaccactgttaaatttcagaattacaaaacctcgaaagatatcaaactagtaaaaatcttagatgataagcacaaatgaattacaaaatctctgacagagagagattaaactagtaaaattcttaggtgatgagcacaaactaattactacaagggtcaacaatcccatcaatcatggactaccgttagaataggttagatcatcagaaatatcaggcctaaccaactcaaatctcaaattggactattactaacagaatttaggatatttgttacgggattttatcagagctctaatttttacctaatgactgcgtactcgccgcgcctctcgaatcggattgaaactgaaccgtaccctccgattcgatgatcggttggtcttttagcaccctcatagagtcaacagaaaccgcctcctcctcctcctctgctctattccgagtcgccaatacagtacggtaaccgtacctccgtttaggagatgaaagatccagatcgtcctgagaacgaagatctgaaccattttctctcaaccttttcaacggaaacaaatttgtcgatttatagatctctctttcgccatcagaggattcttcgctactggatgaacttgaagccggcggaggtgtatttgcaactgcagaccacggcacgacctgattatcttcatcctcctgcacatcatcatcggaaacagctcctccatcgttgccttccccgtcctcatcatcgttttctgcttcggtgtcttctcgatcgccgccgtcgacgcagctctcgcagacggag

SEQ ID NO: 15911 - DNA, 767 bp, Gossypium hirsutum
  Predicted polypeptide sequence is orthologous to G1481
gttcatacttccttttcttttaaccaaacgctccacaattttctcggaaaagaaaaaaaaatgaagaagtgtgaactatgtggaaggctagctcgaatgcactgtgaatcagatcaagcaaatttatgttgggactgtgatttcaaggttcatggagccaacttcctcgtagctaagcataatcgaaccctcctttgtcatgtttgtcaaagtcctactccttggctcgcatctggtcggaatctcggctccgcggtctctgtttgtgattcatgcgttgtgaacggtaataataagtgtgagtcatcggagagagagtctggtgaagaggaggagggagattatgataatgacgccatggaagaaacggaggaggaagaggaggccgagattgaagatgctgaaaatcaggtggttccatggtcaggggagtcttctcctgtctcaatgtcgaagcggatatctagcttgaagtctttgagtactaatgaaggggatggcggcggcggcggcaacggcaacggtgacggtgacggcggttctggattgaagagaatgagagaaagtcttagttcttggtctgatgatgagactggttgctcctcatctcaagtaagctcaagaggatcatccaatggagaagcatcatcgtcaatggaatcatcaagattattgaagcaaccaaaaatagctgaaattaatcaatcagctaggaatcaagatcatggtgaaacaaagtcaaggtcaacggctatcatcagttactt

SEQ ID NO: 15912 - DNA, 866 bp, Gossypium hirsutum
  Predicted polypeptide sequence is orthologous to G1481
gcctaatatcatgcgagtggtggtgtttggttggttaattacggggaggattgctaagcttgtaatttaaagctaaaggcaaggctgttcctagaagccactgcaagtttctcgttttttattccctctctctttctctctcaatcgcccattctctgtgacatacacgaaagagaaactaagaaacgtaaacaaaattctccaagaaaacgaaaggagaaggaacttgctgggagattcaagccaaaatatcttcttctttttttttttgcgttggttgaaggaggaaggagatgaagagttgtgagctctgtaagttagcggcgacaacgtcttgtgaatcggaccaagccagtttgtgctgggattgtgacgctgtagtccacggggctaacttccttgtggcgagacatgtgaggtgtctgctctgtcacgcttgtcagtctctcactccgtggagagccactggttccaagcttggtcgcacggtctccgtctgtgagaggtgcatcgacggcggtgatcgaaaagagagcgaagcggaaaatgacgatgacggtgacggagaagacgatgaaggagatgattctgatgatgacgtgtcagttggagatgatgtggaggacggagataatcaggtggtgccgtggtccacagtagcaaatacacctccgccggcgcctagttcttctagtagcgataattattctggtggtgaaagagaggtctctagatcaacaaatttgttttcattgaaaaggtcgagagggaatgcttcagatcttcactctcaggacgatccggatcgtttatcttcaaaacggaggtacggctaccatactgttttggcgactaggtgcagagca

SEQ ID NO: 15913 - DNA, 903 bp, Gossypium hirsutum
  Predicted polypeptide sequence is orthologous to G1493
ctcttatttctttctcctgtagaagaaaagaaaaatcaactcactttggatcaccaaaatttttcaacatcaaagaaaatagattccaatttatccttgttttattcactcgttggtccgatcccggtttaagcctttcaatttaacccctcatttctagggtttctcttcttcctctctgtttctactgtttctcgttttggtggagttcgttggtttattttggtgaattggaatcgttaagagagaaggattgtgattatagggtttctttttaaatgtgtgagtgagttgtgtttttctgactatggctaccatgcatagagttgtacagtccagtgtgagtacgagtgacgctaccaccaccagctacggcggcttgacgtcatgcaaagcagcggatattgtgatctctgatcagttcccggctgggttgagggttctagttgtggacgatgacattacctgcttaaaaatcctcgagcagatgcttcaccgttgccgctatcacgttactacttgcccccaagccaaagttgctctgaaccttttacgggagagaaaagggtgttttgatgtgatactaagtgatgtttatatgccagatatggatggttataaactcctcgaacatgttgggcttgaaatggatcttccagtaattatgatgtcggctgatgggagcacacgtgctgttatgaagggaattagacatggggcttgtgattatttgattaagcccatacgtgaggaagaattaaagaatatatggcagcatgttgtgaggaagaaatggaatgagaataaggagctagaacattcaggaagcttagatgatactgatcagcataaacgagggcatgatgatgctgaatatggttcttccgccaatgatgcaacaga

SEQ ID NO: 15914 - DNA, 881 bp, Gossypium hirsutum
  Predicted polypeptide sequence is orthologous to G1504
tttctctcattttcctttcatccaaacaatgcctctccttcactcttctgcttgaaacccagaagaaaataaaattatgaataattcttggtttgacaaagggtttgatggggtgaatgatgatttctttgatgatgtaataaagtatttggatttcccattggaagatgttgaaggcactgatggtggtgatggtagtagtggagaaggtgtcatagattttcatttgcctcttgatgatgacgtagaacacaacaactccggtggcggcgaagagtgggattgtaactttcagaacttggaaccgccgcctgctaatgttctcgccggcatgtcttccggcttttctggtgattttttcaatgatagttcgccgaaatgccttacggtttcttgtgatggatcttctcagctaaaccagtggtcgagcgttgcagaagcatcctccggcagaagtgttaccctacacagtgagcccaccgatgtcaaaggttcaatccggttccagacctccagtcccgtatctgtgcttgaaagcagtagtacttgctctgccgcaaatctggtacctattaaccctaaactcggttttctggtgaaacgtggtcgaagcaagcgcaggcgagcatctgcctttaatgtgcacttcacattgcctttcacgtcctccacctcctctacctcccaaggatctaattcatcagttggttctgaatctgaatcagaaagccatctcaccgaggaacctgccaaaaagaaactgaagaagaaaatgaacctgacatggctttcggatttcagcgagatgaagaaatcccctcccgacagcctatcgaagttaggaaatgcttgcactgcgaagttacaaaacccacatggcg

SEQ ID NO: 15915 - DNA, 906 bp, Gossypium hirsutum
  Predicted polypeptide sequence is orthologous to G1512
ccgtcccacgcgtccgtggtctttatctttcttagggtctagttgctcgattgttgctcctttattcaatatctggcattttcatgtgttgatcctctttcattttcttttttttcagagatcaagagtgtcctagtggttaaatctgagtttgttcgaactgatccatggattttgagcaatattatgctcgggaatggaggacagtcccaggtgcttcaacacccgagactttgaatggtaacttcaactgcaatatctgcttagattttgcacatgagccgattgttacactctgcggtcacctttactgctggccttgcatctataaatggcttcatgtccagagtgcctcccttgcttcagacgagcatccgcagtgcccggtttgcaaagcagatatatctcacaccaccatggttcccctttacggtcgtggccaatctgaatctgaacttcaaggcaaggcactttataggggtatggtgatacccccaagaccaccggcgagcagttcacatcctctcttatcacctacatccccgaacagtcagcagcttccttatcgcaacccttaccaaaaccaaaactacaacccccatgcttaccacgaacacgattcatcctccccgttgctaaacctcggaggttccagagtgaccggattccatcatccgcttgttgggatgtttggagagatggtatatgcaagggtgttcggaaattcggaaagcatatacgcatatccgaacccaaactacctaacgggaaatggtaataacccgaggttgagaagacatgagatgcaggctgataggtcactgaatagaatttctatcttcctcttctgtttgtttccttttgtgcttgattgtattttgagcttctattttacttgccattttg

SEQ ID NO: 15916 - DNA, 942 bp, Gossypium hirsutum
  Predicted polypeptide sequence is orthologous to G1521
ctcgtcttcaccgaaaccattggggaaatcggacatccagagattcatacgaagagtaatttgtccggccatcgtcgacgaaacatgtcccatatgcttgagaaccatcgacattcctggagcggcagttctcaccgtttgtttccacgcttactgcttggactgcatccgcaagtggagcgatttgaagaggaattgccctctctgcaattccaccttcgattcttggttctacaaaatcgatctctcctctctaagatacctcaaacagcagttacctgctatctctgactgcaaatcggctattccacgacctcggttcaccgtatctgatcgtcgacggatcatcgaaaggaccagaagagaaataaacgatgttaaccggagaacgagaccgttgccttggcggcgatcttttgggcgacctgggactgtgtcgcctcttgttatcgccgaaaggaagcttcaatggcgtgccagtgtgtataaccgacggctgcaagctgtgcctatatatcatggtaatggttttcagcagaatgttcctaggattaggaatgattttgagaaagagaaactactgcaaagaatagaaccatggattcaaagggagcttgaggctatccttggagatccagatccatcaatcattcttcatgttgtgtcctcgcttctcttctctagacatgaaggaaagcatgatgactcttccgcctcttcgacacagctcagttttgtcaatgacaactttcttgcttctttggaaccttttttacacgaccaaaccaacatgttttggcatgaactcagatgctttgtggagagtccacttaccatggaaacttatgatgcagtagttgagtatagatagatggagtagcggcgcttagccgagttgcatattattttaactgtctacccactatatctgtggcgttagag

SEQ ID NO: 15917 - DNA, 2702 bp, Gossypium hirsutum
  Predicted polypeptide sequence is orthologous to G1535
ttctttttctcttcatcttcttctgcaaaagaaaacaccgacaacattagttgtgcaaagactgtaagagcaacaaaaagagggagaaaaatgtatggagattgtgaagctatttcatcaatgggagggaatctggtggtgtcttcagaaactttatttacatcaacatttcaaaaccctaatttcagttacttgcctttggagcctttacctcctatgatccctaaagaagaaaatgggtcattgttgagaggaaaagaggagatgaaaagtggttccgaaagtgaattacaagaaaccactgagcagccattgaagaagaaacgttaccaccgacacactgctcatcagatccaagaactggaagctgtttttaaggaatgtcctcatccagatgacaaacaaaggatgaaactgagtcaagaacttggcctgaaaccacgacaagtcaagttctggtttcaaaaccggcgtactcagatgaaggctcaacaagatagatcggaggatgtgatacttagagctgagaatgattctttgaagagcgagttttacaggctacaagctgaactcagtaaactcgtttgtcctaattgtggtggtccacctgtgcctggtggggtttcttttgatgaacttcgtattgagaatgctcggctcggtgaagagttggaacgtgtgtgtgccatagcttctcgttacattggtcggccaattcaaacaatgggtgcattgatgccaccttcattagaattggacatgaacatatatccaagacaattccttgaacctatgcctcctaccttgtccgaaacaccctcttatcccgacaataacaacctcatcttaatggaagaggagaaaactattgcaatggaactcgctatgtccgccaccgatgaactcgcgaagatgtgtcgaacgaacccctttgggttcgtaaacaacgaaaccgggaaggaagtgcttaacctcgacgaacattcccgaatgttccactggccactaaatctgaagcaacgctcaagtgaattcaggaccgaagctagccgtgatagttcagtggttataatgaatagcattactttggtagacgcatttgtggatgccaacaaatggatggagctgtttccttcaatagtagctagagccaaatgtgttcaagttatatcacaaggtgtttcgggaaccaacggttgccttcaattgatgtatgctgaattgcattgtctgtcgccattggtgcccacgcgagaggcatatttcctacgatattgccaacaacaaaatgtggaagatgaaacatattgggcaatcgttgatttcccactcgatggctttcataacagtttacaaacatcatttcctttatacaaaagaaggccttctggttgtttgattcaagacatgcctaatggctactcacgggtaacgtgggtagaacatgcagagatagaagagaaaccaatccatcaaatattcagccacttcgtacacagtgggatggcatttggagcaaatcgttggttagctgttttagagagacaatgcgaaaggattgctagtctcatggccactaatatccccgacattggagtgataccatcaccagaagcaaggaagaatctaatgagactgtcccaaaggatgataagaacattctgtgtgaacatcagcagttgcagtggtcaggtttggacagctgttcctgattcctccgatgatactgttagaatcaccacaaggaaagtgagtgaagcaggtcaacccaatggtctcattctttgtgctgtgtccaccacttggctgccttatcctcaccaccatgtcttcgatcttttgagggatgaacgccgccgagctcagctggaggtgctatcaaatgggaatgccttacatgaagtggctcatattgctaatggttcccatcctggaaattgcatttcactccttagaatcaacgtttccagcaactcatcacaacacgtagacctaatgctacaagagagctgcaccaacaaatccggcagcctcgtcgtgtactcaaccgtagacgtcgattccgttcagctggcgatgagcggcgaggacccgtcgtgtatcccattgcttccgttaggcttttttataaccccaatgggactggtgaatgatggtgggtgtaaggacgaagcaaatgggcataatattacaacagggagtttactcaccgttggacttcaagttctagccagcacaataccatcagcaaagatcaatctgtcgagcattgcagccattaacaatcatttatgcaccaccgttcaacaaatcagtagtgctttgagtagcaattgcatcgggtcttgcaatgaaggtgacaatggtaaagaaaaatagggtgttggtgattcgtgaattacccataacatccttaattttgttaactaattgaggaagttattggtaattgtactgaaagtcgtgcactgggatttatagtaattttaatgtggtaaataaagagtgtaatgatgatggagggttaaatttgaaaacttgggggggtataggtgaagtcaagagcgcaccaattgtgaccctttgcttttaatggtaaaggccaccaattaacaagggtgggtggttcgggtatttacttcacctttctttcccttttttttttaatttttatagttataataaacctaaatattttactt

SEQ ID NO: 15918 - DNA, 824 bp, Gossypium hirsutum
  misc_feature (790)..(790): n is a, c, g, or t
  Predicted polypeptide sequence is orthologous to G1538, G1545
gcggccgcgttgaccttaaataaaaaaaattcatcatgacaacccaaatgaaagagcttgaagatccaatggctctaatcacccaaatgtacccttgcatatacactcaagttgcaccacaacaaggggaaatatcgaagcctcgacgacgacagaagaagaacaagggaggggaaagcggggcggcaaccgcggcggagacagctaagaaaaggaagcttagccaagaacaagttgatcttcttgaacttaactttgggaatgaacataaactcgagtccgagaggaaagaccgactcgcttcggagctcggtctggaccctcggcaggtcgcggtttggttccaaaaccgaagagctcgttggaagaacaagaagctcgaggaagagtatagcaagttgaagacaatccatgaaggtgttgttcttgagaaatgtcgccttgaatccgaggttttaaagttgaaggaccaacttcgagaggctgaaaaggaaattcaaggattgacagaacgagtagacggagtttcgagtaatagtccgagttcgtcgtcggttctttctatggaagccatggatccaccacctttcctaggggaatttggagtacaaggatttgaggatcaagatgttttctatataggcatggagtggatgaatctatatatgtgactttaactttaatatgtgtaaataattatgatatttaaaaatatattaaatataatgtaattatatcctaattatcctaattaactttaaatttagagattaatgttattaactactanaaaaaagtcgacgcggccgcggtcgacgcgccgc

SEQ ID NO: 15919 - DNA, 760 bp, Gossypium hirsutum
  Predicted polypeptide sequence is orthologous to G1538, G1545
ccgtttctcaatttaagtgaaagccagaggaaaaaaaaaacacacccgaaaagctagaaagaaagagaaaatgagccaagattatgaaatgatgacaagccaaatgaatgaacatgaagatcatattgctcttatctcccaaatctaccctggattttacacccaaattgcaacacaccaaggtactgatcaatgtggcatggacttaaaaccacaaacatatttattcttgcattgttttataattaagccaggcttttggttgagcaggggaaccgaagcctcgacggcggcggaagaagaacaagggaggggagaacagccagtgtgcggtggctaaaaaaaggaagcttaaccaggaacaagtcactctccttgaacttaattttggtaacgaacataaactagagtcagaaaggaaagatcggattgcttcagagctgggacttgaccctcgtcaggttgctgtttggttccaaaatcgtagagctcgttggaagaacaagaagctggaggaagagtatagcacgctcaagtctcttcacgaaactgttgttctcgacaaatgccgacttgaatccgaggtatgtaaatatacatatatcttttatttcccaaatgaaaatcattttaacttgcaaaaaaagaaaaaatccggttttaatcacacttgtaagtttatttggatgtttaaatgcaaaccctttgtttttcttatattttagacataattccttgtggtttcttagaaccaaacagg

SEQ ID NO: 15920 - DNA, 876 bp, Gossypium hirsutum
  Predicted polypeptide sequence is orthologous to G1554
ctagcatgtcaccactattcttccaaacaacaacttttatcagatagttttctttttcttcttctcttgtcttttattacagtcagacaccccgtacaaaaacaaaaacatggcatcatcttcttcttctgaactaacccttgattgtaaaccccatggccattttgcggcgccgtccaagtgttacgcagaccagcagcagattgttgttgttaatcatacattgaagcttgaagactacctctctcgtctcgaggaagaacgccttaagatcgatgctttcaaacgtgaacttcccctttgcatgcaacttcttaccaatgctttggagtcctcaagacaacaactacaggcataccgagcgaatcaaggaccaaaaccagttcttgaagaattcatgcccctcaaaacctcagtgtcggagaacatggacaagttccaaaccatatctgatcataaagccaactggatgaccactgcacaactatggagccaagcaggacattacgaaaccaaaccacaatcctcctcaattactacatcatcccctaaagacactgatattggtctgaatgttgttagtcccaagttaggatcatcattagattccaaacaaagaattggaggagctttccttccattctccaaagacagaaactcatgcagtactgctctccctgatttatcacttgcttcttcagacactgaaaacggaacatcttgtcaacagagagatgatgggacaagtaacaacagaactgatgggcaaacaacgaatggttctaatactaatcaacctcataggaaagctaggcgttgctggtcacctgatttgcacaggagatttgtcaatgctctccaaatgcttggtggctc

SEQ ID NO: 15921 - DNA, 724 bp, Gossypium hirsutum
  Predicted polypeptide sequence is orthologous to G1638
cttaccctataaagattcatcacttataacactccccttctctatatcctctctgtttcttttctcgcttgatggatttcaagtattctttttccagctttaatctttcactttatgagttaagtttctgaattttaatttgcatatagattttcttgttattctgtatgattttagatctgttatggatgtctaaggctttcaagatttgatacttctttgctcatttaacaagtcacttccctgcatttttttacatctttgagttgctccatttcaaagtgggagagaagcaagtttttttttttaatcatgattaatcggggacttcaagttctatctcaaacctcttacttacaaacttggaattggttgtttcaagagagcaatggaacaaaatggagtgctgaagagaacaagtgtttcgaaaatgctctagctttatatgatacagacacacctgaccgatggtttaaagtggcagcaatggttcctggaaaaactgttgaagatgtcatcaaacagtatagagaattggaagaggatgtaagtgatatagaggcgggattgattccaattcctgtgtataacactgattctttagaattgacttgagttaagaatatcaaggatttaaggaattaaaacttttaactccttgtttgtaaaaattgtttggttcttacttctgatctgactgacaatgtttcctgcatgagaaaaa

SEQ ID NO: 15922 - DNA, 563 bp, Gossypium hirsutum
  misc_feature (51)..(51): n is a, c, g, or t
  misc_feature (352)..(352): n is a, c, g, or t
  misc_feature (433)..(433): n is a, c, g, or t
  misc_feature (500)..(500): n is a, c, g, or t
  misc_feature (553)..(553): n is a, c, g, or t
  Predicted polypeptide sequence is orthologous to G1638
caatttcgtgactacccgaacaccgactcaagtggcaagtctatgctcagnaaatactgtcatcaggcaggatcaccggggggtaaagacaagaggaggtccagtatccatgatatcacaacggttaacgtccctggatactccctcttcgtcaccggatcactgcaagcattcgtcttcaagtgattcttctgcagtcatacaggcacagcagcaagctaaactagccacaactaaagagatcgactttgaatgtaagcaacaaaatggagcagctatggttttcaaccggacgagtaattgcaatgctttcctgccccccttctgtgggatttcatcatacggacccaanctggaggaacaaaatttgcttggagaaactcttcccagatctcaattcggatcttacaacactcttttccagatgcagtcnatgcaacaacatcaataaactgagtgataatgtgggaagacttttctcaaggtattattattagttnaaagagatgaagatgaagcctactagtgatgtgtatatcttggagatgcattnttagtccata

SEQ ID NO: 15923 - DNA, 700 bp, Gossypium hirsutum
  Predicted polypeptide sequence is orthologous to G1638
gattttcactgatttttgatgttgtaatgattttgggtttttgaattttgatttatatattgatttttcagtgttttaattcagtgttttagttggattttggatctttttatgtatatctaggtttttttttcatcaagatctgattttcccttggattttggaacttgaggttcttttaaagagattccttcatggattccattaatgcttgaatgatttaaaagttaaaaaaacaaccatttctctgcaatttttttccttggattttctctctctttgaacaagagggagaaaaaaagcagagcttttatttttaggggcaaatcatctttggcaaagaacaatgaataggggacttgaaatcctttcaccagcttcttttttacagacatcaaattggttgttccaagagagtaaaggtactaaatggacaccacaagagaacaagtgttttgaaaatgctttagctttgtatgataaagacacacctgatagatggtttaaggtagctgccatgattcctggtaaaacagttggtgatgttatcaaacaatacagggaattagaagaagatgttagtgatatagaagctggtttgatcccaatccctggttatagtagtgattcttttacgttggaatgggttaatgatggtcaagtgtttgatgggtttagaaattattattatacacctggt

SEQ ID NO: 15924 - DNA, 773 bp, Gossypium hirsutum
  misc_feature (756)..(756): n is a, c, g, or t
  Predicted polypeptide sequence is orthologous to G1641
ccgtcacacgcgtccgcgaaatggacatcagcagagaacactttgttcgagaatgccttggcggtttacgataaagatactcccgatcgatggcagaaagtggctgagatgatcccagggaagacggtgggagatgtgatcaagcaatatagagaattagaagctgatgttagcagtatagaagcagggctggttccaatccctggatatagcacctccccattcacattggattgggtgaatagcaatggctatgatggattaaaacagtcctatggacttggcggaaagagatcctcatcaggcagggctgcagatcatgagaggaaaaaaggggttccttggacagaagaggagcataaattgtttttgatggggctaaaaaagtatggcaaaggggattggagaaatatatcacgcaatttcgttgtcactcgaacaccgactcaggtggctagtcatgctcagaagtatttcattaggcagctttctggagggaaggataagagaagagctagcatccatgacataacaacggtcaatctcaacgacatgagaactccttcaccggacaataagggaactccttcacccgaacagtcttcggtgctcactcagcagccaaattctgctgccatgcccagaacacactttcaatggaatccgccttgtggtggggcaacaatggctttcaattcaacacaaggaagtatgttgatgtcttctccttacggggttccctcctatggattgaanatgcaggggcagagtct

SEQ ID NO: 15925 - DNA, 683 bp, Gossypium hirsutum
  Predicted polypeptide sequence is orthologous to G1655
tccatctccatctccatctcctttctgcaattattcccaactttccatggcttccttcacacccaatctagaacctgcccctgacacctctcttcagttcaagcccaagaaacccaggataacccttcaaaccccttcctcttgtcctcccaatcaacgcatccaaagaattaagcgatggcggacccaacgagaccaacacatctactcctccaagctcttccaggctctccgtcgttctcgtcgtacctccgcctccagggaagtccacgaaacggctgacagggttctcgccgttttggccaagggcaccactcgttggggcagagccattctcaccgctcgcaaggtgaccaaacataagaaagccaagctccctactaataacaggttgaggaagcccgatatttacagagagaggaggaaaacgccggctgttgagcggaagttgaaggttttgggacgtctcgtccccggttgccggaaactatccttctccaaccttatagaagaaactagcgattacatagcggctctagagatgcaagttcgagccatgacggctattaccgagtttctctgcggcggaactggcggtggaccgcagccgccggctgatcgccttccctctaatgtcaactcttgaaaaggtgtttattattaataattattattattttttg

SEQ ID NO: 15926 - DNA, 962 bp, Gossypium hirsutum
  Predicted polypeptide sequence is orthologous to G1660
cttcagctctcaagcaacaagcatggtgtagtaataataatagtagcgatgctgccagttcagtgtttctagcttccgtttctatgttttatctgcggagtgtaatattgaaagtaaatcagttttcattttcatggattacgaaagaatccaaaagcctcagggtggaggtggattttcccctgctaaactaaggactatgctcctaggagtagaaaagaaaagaaaacaagaagaagaacaagttgaatcttcagtagatttaagatctgaactttctcaccttgatgacgattcagggaaaagtggctctgatagttgcaaagatgtagatgtggtgagtgttcttccagaatgttccacttctacaacagctagttctacagctgctatgcaaaatgggaacgagcgaagatcaaaggatcattctttaggcactgctcaaaaccggttcattgaggatcatcctggtttagattatgatagtgggcatgacaatatgagtgtgtcctcgtcgatctttgagtttcagaagactgaacgagcaccgcaaagggttccccttgggccgttttctaagcctgctccatcgaaatgggatgacgctcagaaatggatagccagccctactgcaaatcggccgaagacagggcagggtgggcaaggagtgggatcaagaaaaggaggtaattttggttacgggaggcaatcgtctactaaggtggtcattgaagttccagatcaaaggatggttgctttcgaagaaccggatacaaaacggattgatactaatcatgctaagaaggatgatgggctgcagaagtttgttaattggggagagtgatccatacccagttgtggattcatatgggaagcctgtactaatgatcgggaactctgttgctgagtcagctattagtcttagccagcatgattcatcatatcgatacatagttgctacg

SEQ ID NO: 15927 - DNA, 913 bp, Gossypium hirsutum
  Predicted polypeptide sequence is orthologous to G1666
tttgaatttgtctgtctgatctctcacctgttgctcttttttcttctgctacccttcctcgggctcctcttgtctacccttcttttccttttcctttttgctcctttttaaggggttttggggtttgggtaaagggttttttgtgattttcagctgcagatatcatgatatataggatgattttatgattctgcttctttctgtttcttcactagtatataatatcccattttttccttctcattttctgacattaatatccagctcaaatttggagtgaatggctgtgccgcctagtaacaggcttcggaatatgttgcaggcggcggtgcaatcagttcaatggacctacagccttttctggcaaatttgtccccaacaagggatcttagtatggtcagacggatactacaatggagcaatcaagacacgaaagacactgcaaccaatggaggtcagtgcggaagaggcggctttgcaaaggagccaacaacttagagagctctacgactcattatccgccggagagtcgaaccagacagtccggcgaccatctgcagcgttgtcaccggaggacttaaccgagtccgaatggttctatttgatgtgcgtctccttctcttttcctcctggagtagggttgcctggaaaggcatatgcaaggaggcagcatgtatggcttactggtgcaagtgaggttgatagtaaaattttctcaagagctattcttgctaagagtgctcgtatacagactgtgctttgcattgctgtccacgatggtgttgttgaacttggcactacggagaagctccaagaggatctagagttagtccaacatgtcaaaccttcttcacagatgatataattcgtaaccccaaaccggctctctcggacactccacttcgaacccgcc

SEQ ID NO: 15928 - DNA, 920 bp, Gossypium hirsutum
  Predicted polypeptide sequence is orthologous to G1666
attacaaaaaaaaaagtgggtctcatttcttcttaaaaagtcatctaatttgtctttcttcttcttttttctctgatatgtagcttcttttcttcggactttgcctgtcagacccctttttttgttggtggggattaaagggttttttctttttttaattttcaggtggagatcataaaaccttagtatctccaaagggaaagttgtgaattttgtttgtggttttttttttaacgtaaaaatccaagctttaaatctgaaagttaatggcggcgccgccgagtagtaggctacaaaaaatgttacaggctgcggtgcaatcggttcaatggacgtatagtcttttctggcaaatttgtcctcaacaaggtatcttaatatggtccgatggatactacaatggagcaatcaaaacaagaaaaacagtgcaaccaatggaagttagtacagaagaagcatctttacaaagaagccaacaactccgagaactttacgactcgttgtcttccggcgacaccaaccaaccggctcgacgaccgtctgccgcgttgtccccggaagatttaacggaatccgaatggttctatctaatgtgtgtctccttctcttttccccctggtgtagggttacctggaaaggcatatgcaaggaggcaacatgtatggcttacaggtgcaaacgaagttgatagcaaaacattttcaagagctattcttgctaagactgtgctttgcattcctattcttgatggtgttcttgaacttgggtatactgaaaaggtgcaagaagatttagggttagtccagcacgttaaaactttcttcaacgatggacaagcaccaaaccctccgccaccgaaaccggctctctccgaacattcaacgtcgaacccggccgcttcatcggactacactcgattt

SEQ ID NO: 15929 - DNA, 627 bp, Gossypium hirsutum
  misc_feature (461)..(461): n is a, c, g, or t
  misc_feature (484)..(484): n is a, c, g, or t
  misc_feature (494)..(494): n is a, c, g, or t
  misc_feature (499)..(499): n is a, c, g, or t
  misc_feature (607)..(607): n is a, c, g, or t
  misc_feature (609)..(610): n is a, c, g, or t
  misc_feature (612)..(612): n is a, c, g, or t
  Predicted polypeptide sequence is orthologous to G1743
gggtttcccagtagcctactcagagcttcttcttccaagattgcttctccacacgctttctctccttgcttaccttcgcaaatttatttccactctcttcctctatttgggtctccccgatttcctcgaacccgacattccttggcgcgaatacgcccctgaaacccaccacgcttccgccgcccccgtctctgctctcctcatccgggaactcctacccgtcgtcaagttctccgacctcgtcgacccgccggagagctgcgccgtgtgcttgtacgacttcgaagggcaggatgagatcaggcggctgactaactgccgccatattttccatcggagctgtttggaccgttggatggggtatgatcagaaaacatgtccgctttgtaaaacaagtattgttcctgatgatatgcaacaaacgtttaatgagaagctgtgggctgcctctgggatccctngaatctttggtgattattctcanattactgctntgtanttatacctgtgcttcccacaaaaaaaaaaatgcttttttgtttatcatcttataagagttggtttgtatatatacatgaaaatcccggaaattaccgccatgatcctncnncnagaaggagagatcat

SEQ ID NO: 15930 - DNA, 675 bp, Gossypium hirsutum
  misc_feature (473)..(473): n is a, c, g, or t
  Predicted polypeptide sequence is orthologous to G1743
tttttttttttttttttttaaaaaataaaatggtggattttattgaattcttaagaacccaaaagccatatttttaacctaaaatttatctaattcttttcgaatatataaaatttaagcctaaaaaagggatactgttttgatccgtgtacatttataatgtacaattttttcactaaactaaatggataacacaaaatttacaacccggcaacggaaccgtactcactgtaaatatcgacgattccagaagctgcccagagccgttgattaaattcagcttgcatctcatcaggtacaaacgatgtcctacaaagcggacacgtcacctgatcgtgatccatccagcggtccaaacacgttctatgaaaaacatgcttacaattcttcaaccacctgatctcttcctttccttcgaactcgcacaagcaaacggcgcaactctccggtggatcaccaccaccgaccaccgngagttcctcgaactttacgacggctaggatttcacggatcaagagagcgggtaccggcggtttcaaaggtgtggttcgggttgggttttccggccaatcggtgtcggtttcgaggaaatcggagagtccgaggtaattaaaaagtgagaggattaggtttctgatgaaacccaaaaacgatagcgtgtgaacgaagaatttg

SEQ ID NO: 15931 - DNA, 296 bp, Gossypium hirsutum
  Predicted polypeptide sequence is orthologous to G1743
aagaaaaaataaaatggtggattttattgattcttagaacccaaaaatcatatttttaacctaaaacttatcaaattcttttcgaataggtgaaatttagcctaaaaaggggataatcttttgatccgtgtacatttataatgtacaatttttttcactaaactaaatggataacacaacaaatttacaacccggcaacggaaccgtactcactgtaaaaatcgacgattccagaagctgccgggagccgttgattaaactcagcttgcatctcatcaggtacaaacctaaatgga

SEQ ID NO: 15932 - DNA, 426 bp, Gossypium hirsutum
  Predicted polypeptide sequence is orthologous to G1750
tcttcactaagatggtgctcttcgagcctggaggaattcagccccaaaatctttcctcaactttgatttcaacgaagaaaggagaagaaatccatggcctgttcgcacggttcggttgtacggagaagataaccctggtgacgtggaggccgcacgcggggatctcacgtgggaagccaaccctctggccattccagtgtattccagaagcttctggcgctctcaggctgctgagcttctttttgggtcctgttgggcctcgggtttgggctatttgtaaactgggttagggatgtgggtttagtatttggattttgaaaattgtaagtggactttgtggactattttagtcatggactttattttaatttatttgggtttatttatttgacttatttattataaataaaaaaaaaaaaaaaaaaa

SEQ ID NO: 15933 - DNA, 860 bp, Gossypium hirsutum
  Predicted polypeptide sequence is orthologous to G1765
tttttgccttctacttagccagcaaaaagaataaaaaagaatcaaagatgaacatggtccatggcaccaccactactgtggaagaagatgttccacttcccggtttccgattccacccgaccgacgaagagctcatcgggttttaccttcgacgaaaagtcgacaacaaatccttaagaatcgaactcatcaaacagatcgatatctataaatacgacccctctgatctcccaaaaaccagcatgatgggagagaacgaattgtatttcttttgtagacgaggaaggaaatatcgaaacagcgtaagaccgaatcgggtgacgggatcggggttttggaaagcgacaggtatcgataagcctgttttttcggttggaagcagtgaagccatcgggctaaagaaaacgttggtgtattaccgtggaagtgcaggcaaaggaactaaaaccgattggatgatgcatgaatttcgccttcccaatcccacattgactgcacaagatgctgaagtatggacaatatgtcgaattttcaagcggcataaaaagaacaaacaagaatggagacaaggtgctactaaacgagcttcaactagcaatggcaatggtgtacatggctatgaacgttgcagtgtagaatccagcagccatgaaaattacattacatttggctctcaaagcattgaaaactatgatgataatgatgatgatgatggtgatggtgaaatggttatggatcatatgaagaatgacgggagttgcagaagggaatggtatcatggagagatgcaatgtatggtatcatcatcatcaccatcttcaagcttttctactgaaaatgatttcttcacaaatgctaat

SEQ ID NO: 15934 - DNA, 812 bp, Gossypium hirsutum
  Predicted polypeptide sequence is orthologous to G1777
gcggccgcgtcgacctttggaacatctcaaatctcgggttgagaaaattactcaaatattcaaaagcccaaggcttctgtacattaaatggattttcagttcacacaacctctgaaagacaaaagaacctatggacatccatgattcatcttccagactatctaaaatagaaaggaagtacaaaatgggggggggggacaaaaaagatgctaagcaggggaagtaaaagcatttaagcggttctctgctcaatccataaattatcaactcccattttagataaaatgagggtctctctagttagatatgtacatatgtacttatctagaaaaaaaagcctacttagagatcaattcctgtcaagaacttctgctggcaagttgagatcaaagaaaccacctccataactttccttcttaggttgctttggtgatgggcaacctttgtcgtctgaagtcccaaagctgaaagatcggtcacgtttgccgctagtgccacaatctgagggatggcatttaccagtagtagtactggctttaccattccaacagacagcaagctctgatgctttctcaatgcccttggatttgtatggagcgatattatgggtatttcgttggagagaacccagcaaatcattctcaatgcactcatacattttcttacaaagggaatcaatgatcacagaaagattgattacttgcattcgtatctccataactttatcatcagtatattgatcaaagggctcttccaaaaacttagaaagtttctcaacatttgcctcaagttgctgctgctgatcctcaaat

SEQ ID NO: 15935 - DNA, 550 bp, Gossypium hirsutum
  Predicted polypeptide sequence is orthologous to G1789, G1911
aatgattaatgcacgatatatatattcattaaaaacaggaacttttttatgtaccagtgctatgagataattaattggtacatataaggaagcacaactagtgtaaaccaagtatatagaatgaagatacaactttcaatttaagatacactttgagaagaaataataggcgacatatttgctgcttgttgcaccagacaactggctgcatttgctttattaaaggctaaggcctttgtttctaccggtttctgctcatatttcactgaagcctcagattcctcattctttgttctccatccgtgaaattgtatcctttgttccctccagctttcttgtaaggaggtaagggcacttggccagactcaatctgttggatgtcttcgacaaggttctggtaatgtagcttcacttcctccacggttttccctccaactgccctggctagattgtgccagcggtctggggtatctttgtcgtagcatactaaagcattctcgaacaacttgttttgctttggtgtccagctcgaacctgaggccattgcaat

SEQ ID NO: 15936 - DNA, 606 bp, Gossypium hirsutum
  Predicted polypeptide sequence is orthologous to G1789, G1911
ccttaaaacgcgtccgctctttttcttttcttctcttttctttggcctcagacccttaatttcgattgttaattatcactgttctgcaatggcgtcaggttcgaactggacgccaaagcaaaacaagttgttcgagaacgctttagctatctacgacaaggatacaccagaccggtggcacaagctagccagggctgtcggggggaagaccgtggaggaagtgaagttgcattaccagaaccttgtggatgacatcaagcagatagagtctgggcacgtgcctttgcccccttataagaaagctggagggaaccaaggatacaacaatttcatggacgatgaagaaccaaggatgaggaatctcaggctttagtgaagtatgaaccagaaatagctgtagaatatcaacctttcaataaaaggaaatgcaaagcagcaaacatataaattatctcttaatttcgtttacatttcctgctcatatatatgttttttgtgtgcttgaatgtaacaagcagccacaacgctcctatacttgcatgtgtcaagtatgaaattatagcattggtaccttgtttttattaatgttaacctatctttgttctt

SEQ ID NO: 15937 - DNA, 550 bp, Gossypium hirsutum
  Predicted polypeptide sequence is orthologous to G1835
cgcagttttttttttgggaaaagacataattaggttagaagataagataggtggactgataggaaatgtaaagacatctaggtgggttacatcactaaccctaatttgaaatccaccctctacttcccggtgattttatatttttctgctactcctcctaccaaacatgtcatcatctaacatcctacttattccactaatgtacacactgacaaacaaggaaaataatgataataataatagtaatagtaaaacacagaacaaggaagctccctgctaaatgcctgtaaactaataatcaatgcggttgctatttctggtggaattaacaccgtagatggtgttaccgacttcagcagcttggcattgtttcctcatctctatcaccttctgtgagagttggagtgcaatgatgcaacaaatgtaggacttgcagcaggacggtattctggaaagaggcggcagacctgtagcgaaccccacatgcattacaaagggtctttggaccctgggtccttctctccatgtgtggagttttgtaacttcacag

SEQ ID NO: 15938 - DNA, 952 bp, Gossypium hirsutum
  Predicted polypeptide sequence is orthologous to G1835
cccttcccttccttcttaatcaagctttctcgagaaaattcacttcattttcctggaaattatctcttaattccggaaagttttgctcactgattagtaacaaagatttgtttcaattgttagtgctatatagtaaacatgattggatcaacggatttcattgatgagatagattgcggcagcttcttcgatgatctcatcgacttccctaacgaagatgtcgaagcgtacgagtccaccgccgtcatcaacgccgccgcgtttcctagtatttggacaactcagcccgagtcattacctctttcggactcggtttttctcaacaacagtgcttccgagctttccactgaactctttgttccgtatgaagatattgttcaattggaatggatgtcaaaatttgttgaagatactcagtgtggagcaagcttgacaactaagaaagaagattcctcttcaatcagtgagggatccaatcatcaattccagacttgcagtccggtttcggttcttgaaagtagcagctcgtgttcaggaatgaaaccattgcctcgcagtcctgaaacgtctgcccctgggaaacgcggacgtccacgaagcaaatgtcctcgtctggccactttcaatcatcttccaggagttcagatgacctccccagcttcatctgtcaatgagaacgacattccccagccatttgctgtcccgaaggtgctgtcagattctgagaactatgctgagtcacggcttctgatcaaattaccgaaacaaggcaatccagaacataagaagaagaagatcaagttatcggtttcagctgcagcagccattgctgatatagtcaaatccactggacagctgttaggaatgtatgcactgtgagatactagacacctcaatggaggcaggccatgggtccgaaacctttgcatgctgtggtgtccgatacagtctg

SEQ ID NO: 15939 - DNA, 969 bp, Gossypium hirsutum
  Predicted polypeptide sequence is orthologous to G1835
ctcgaacaattctcttcattttcctggaaaattatctcctgtttccccagaaaagttttgctcacttagtaacgaaaggtttataaatttcttagagagaaattattaacataaagaaaccatgattggaccaaccaacttcatcgacgagatagattgcggcagcttcttcgaccacatagacgacctcctcgacttccctaacgaggatgtcgaagctggtttctccgccgctgattccgccgtcaacgccgccgcttttcccagcatttggactgctcaccccgagtcattcccgggttctgactcagttttttccaacaacagcgcttccgacctctccgccgaactctctgttccgtatgaagacattgttcaattggaatggttgtcaaactttgttgaagattcaaattgtggagcaagtttgacaattaagaaacaagagcctaattcaaacaataaggactcaccatcccatcatgatcatgatcaccatcaattccagacatccagtccggtttcggtcctcgaaagcagcagctcttactccggggagaaaccggttgccgcccctgggaagtgcggacgtgcgcgtagcaaacgtccccgtcccgccactttcaaccctcgtccagcgattcaccttatctccccgtcttcgtccgtcaatgacaacgacgttcctcagtcgttgtttgttcccaaggtgccatccgactccgagaaccacgctgagtctcggcttctgatcaagttgccacgacaagttaacccggaacacaagaagaaaaagaagatcaagttgacactcccagcagcagcaccaccacctactgataacaacactactcaaaatccatctgttaggaatgcatgcattgtgagataacaaagacacctcaatggaggcaggccaatgggaccgaaaaccctttgcaatgcatgcggagtgcggtataaatctgg

SEQ ID NO: 15940 - DNA, 569 bp, Gossypium hirsutum
  misc_feature (454)..(454): n is a, c, g, or t
  misc_feature (515)..(515): n is a, c, g, or t
  misc_feature (532)..(532): n is a, c, g, or t
  misc_feature (536)..(536): n is a, c, g, or t
  misc_feature (559)..(560): n is a, c, g, or t
  Predicted polypeptide sequence is orthologous to G1838
ggaagagatgaagcatgcgaccaagcaagagtttattgcatccttgaggaggaaaagtagcggattttcaaggggtgcatcgatttacagaggtgtcacaaggcatcatcaacagggccgatggcaagcaaggataggtcgggttgcaggaaacaaggacttgtaccttgggacttttgctactgaagaggaggcagcagaggcatatgatattgcagccatcaagttccgaggtgtcaatgcggtgaccaacttcgatatgagccggtacgatgtcaaagccattgcccagagttctcttcccattggtggggcagctaagcgcttaaagctttcacttgaatcagagccaaaaccgatagtgaaccagaagcaacaaccaccaccaccccggtgcagctccaacagcaatattataagttttgctcccatgaaacagccggtttccactatnccttgtggaatccctttcgatgcagcagcagcaatggctgcatttatcacagaatatctancagcaccttcagactgncacncagtgttctgaccccagtcttcnnacacgtatg

SEQ ID NO: 15941 - DNA, 1021 bp, Gossypium hirsutum
  Predicted polypeptide sequence is orthologous to G1852
tgcaaacctcccactcctttgcttctgcaacaaagttaaaacctactccacttctcaaatttcattcatacaatttcaaccaaaccctttatccaatctggatccgcaaccaaatcctgtgataaaccagccattaaactaactactcataccgaagatccaaaagcatgggtcacttaaatctacctgcatccaaacgcaacccccgccaatggaagcttttggacatcataaccgccatattcttcggcctcgtactcttgttcttcctcttagtcttcacccctcttggggattccatggctgcctctggtaggcaagccctgttgctttccacctctgatccgaggcaacggcatcgcttggtgtccttggtcgaacttggccaccaccacaagcccatcgaagcttgccctgccaattccgttgatcatatgccctgtgaggaccccaggcgtaacagccagctcagcagggagatgaatctatatagagaaaggcattgtcctttgcctgatgaaatgcctctttgcttgatccctcctcctcctggttataagattcctgttcagtggcctgaaagcttgcacaagatatggcactccaatatgccacacaacaaaattgctcataggaaaggtcaccaaggatggatgaaaaagcaaggtcctcactttattttccctggtggtggaacaatgtttcctgatggagctgctccatatatcgagaaacttgggcagtatattcccttgactggtggaactcttaggactgcccttgatatgggttgcggggttgcaagttttgggggttcattgttatcagaaggcattttggcactctcatttgctcctagagattcccacaaagcacaaatacaatttgcattggaaagaggaataccggcctttgttctaatgcttggcactcgcagactcccgtttcctgcatttgcatttgatttcattcactgctctcgatgcctgatccctttcacagcttataatgcaacttattt

SEQ ID NO: 15942 - DNA, 931 bp, Gossypium hirsutum
  Predicted polypeptide sequence is orthologous to G1852
cttccacttcctttctatgcaaaaaagctaaaaagtcttcaatgaatcattgaaatttaaatctaatcaaagcttcaacaaaacatgggtcacttaaatctaccaccatccaaacgaaatccgcgccaatggaaacttttggacatcgtctccgccttcttcttcgccctcgtactcttgtttttcttgttggtcttcacccctctcggcgattccttggctgcctctggtaggcaagctttgttgctttccacctccgatccaaagcaacggcatcgtttggtggagctgttggagcttggccatcatcaccagcctatcgaagcttgccctgctgattccgtcgatcatatgccgtgcgaggatcctaggcgtagtagtcagctcagtagggagatgaatttctatagagaaaggcattgccctttgcctgatgaaacgcctctttgcttgatccctcctcctcttggctacaagattcccgttcagtggcctgaaagcttgcacaagatatggcattccaacatgccacacaacaaaattgctgataggaaaggtcaccaaggatggatgaaagaggaaggtccttactttattttccctggtggtggaacaatgttccctgatggagctgcatcgtatatagagaaacttggacagtacattcccataaccggtggaactcttaggacggcccttgatatgggctgtggggttgctagttttgggggttcaatgctaaaagaaggcattttgacactctcatttgctccaagggattcacacaaagcacaaatacaatttgttttggaaagagggataccagcctttgttctaatgcttggcacccgcagactcccatttcctgcatttgcatttgacttaattcactgctcctcgttgccttatcccttttacagcttataatgca

SEQ ID NO: 15943 - DNA, 457 bp, Gossypium hirsutum
  misc_feature (95)..(95): n is a, c, g, or t
  misc_feature (266)..(266): n is a, c, g, or t
  misc_feature (380)..(380): n is a, c, g, or t
  misc_feature (402)..(402): n is a, c, g, or t
  misc_feature (413)..(413): n is a, c, g, or t
  misc_feature (432)..(432): n is a, c, g, or t
  misc_feature (443)..(443): n is a, c, g, or t
  Predicted polypeptide sequence is orthologous to G1852
gcacgaggaaagcttcctggttcaagcaagagcaggtgtaaccttgtggacctaatggtggagatggatcgcatgttgcgtcctgaaggaacagntgtgattcgagattcacctgaagtaatcgacaaagtggcacgcatagctcacgcagtaaggtggacggctaccataaatgacaaggaacctgaatcacatgggagagagaaaatcctggtagcaacaaaaaccttttggaagctaacttcatcccattgagacagacttgntctttataatgtaggtattttccttttcgtttcaatttttttattatctcgagccaagttgtcttcctcatgcatcaaatagatgcaatcttgtttcttgctcactatttgggnaatatttatatgaagaaactgnagaagtacaanatatatattcatataaaancaaaagggctncagctttctggcag

SEQ ID NO: 15944 - DNA, 903 bp, Gossypium hirsutum
  Predicted polypeptide sequence is orthologous to G1863, G2334
ggggctgagagtgccggtgtggggatggtagcaatgaggtcgtcatcatcaccatttacagtgtcacagtggcaggagctggaacatcaagctttgatctttaagtatatgatggcaggtttgccagtgccacctgatcttgtgctccctattcagaagagctttgagtccatatctcaaagtggggtattgttccttttatgggaagaaggtggatccggagccaggacgatgtaggaggaccgatggcaagaaatggcggtgttccaaagatgcgtatccggactcaaagtattgcgagcgccatatgcaccgtggccgtaaccgttcaagaaagcctgtggaatcacaaactatggcacagtcattatctactgtgacatcattgactgtttctggtagtactaccagtggtggtgggactgggacggcaagcttccagagccttccattacatgcctttggtggtacgcaagtcactgctttggcaaccggtcagtctaattatcatgtggagtcaatcccctatggaatcccgaggaaagattataggtctcaaggaataaaacccgacgcgggtgggcatagtttcatctctgaggctttgggaagcaaccgggacacatggcctctaatgcaatctagagtctcttcatttcctcagtcaaaatccgatggcaacccggtcttactgaatgattaccctcagcattcgtttttcagcgatttcaactcgggagaaactgtgaagcccgagggtcaatctcttcggccgttctttgacgagtggcctaaaaccagggacacctggtcagctcttgaagatgacagatccaaccagacctcattttctacaacacagctatcgatatccattccgatggcatcatctgacttctccac

SEQ ID NO: 15945 - DNA, 836 bp, Gossypium hirsutum
  Predicted polypeptide sequence is orthologous to G1865
cataacgcgtccgatcacccctttatgtatccccatgcatctagacctccaggggttggcctgtcacctcaagaaaacaccacacattctctcctcggctctggctcttactcccagactaacacggattacaggagaaacagttatgtttatgggttgaaagaagaagtagatgaacatgcttttttctctgaaccttccggtacaatgaggagtttctcaggttcatctgtggatgattcatggcaacttgcaccactaacaatgagctcctcttcctcaaagcagaggaactgttctggattacagagtgaatactcttacttgcagcttcaaagcctcactgatcacaacccgaaacaaaacaaacaggatgctgatgaacattcctatatcaaatatgaaatgactgatgaattggagaaaggcgaaccccaaaagacagtccatcgtttctttgatgaatggccaccaaaacatagagattcatggcttgatttggatgataaatcatcaaacagctcatcagtttcaacaaccagactctctatatccatcccttccacttcacatgacttccccattttcaattcaagagctcataatgatggttgaatgtccagtggtaggtttctgcattagaggccaaagatgtacgtagtggggatcacttctttctgtgaattctgactgtttagtctttcatttatttcttccttctcctttggctttttgttttattgttttttgttttctgttctctttttgctaaatatggttaaattgggttgtgtttcttttttcccttattaatgaatgatccaatgacttcttac

SEQ ID NO: 15946 - DNA, 992 bp, Gossypium hirsutum
  Predicted polypeptide sequence is orthologous to G1868
cgaacggatggaaagaaatggcgttgctcccgggatgccgttgctgatcaaaagtattgtgaaaggcatataaacaggggccgccatcgttcaagaaagcctgtggaaggccagaccggccacactgccactaattcaaaggtggagtcgatgtcttcctctatgttggcatcggcaaaaaccagtggtggtgcagccaatagtctcgcaattgcactgcagcaccggtctggtgctgctgatccttcttcagacacccttgtgaacagaatacaagatcaacgggggttttcggtgttgtcttccaccaccaacctgaaatctgatgactccaccacattcaccattacaaaacaaggtgttccgtttgtagaatcatctctatcggattttggacatgttgcttccgattctcttgtcaatccgtcgcataaaagctattacatgaactctaaggagtatggtcatggtctgttcctagacttcactggtcaagaaacacaagatcaaacaccgcctcaccaattcattgataactggcccaaggatcagtctagtcgttctattgttacttggccaaatgagttaaaacctgactggactcaactctcgatgtctattcctatggtaacatcagagttctcatcaaccttgtcctcaccagtgaaagagaaactcgacctttcatctcttaggttagttcaggagttcgatcagatccaaatgggtttaggagtgaacaatgacatcactgaacaaaccaaaaggcaacctaactggataccaatatcttggggaggttcaatgggaggtccattaggagagatcttaaacaacacgacgaacaacgcaggtagctgccagaactcatcgacacttaccttcttatcggaagggttggatggcaaccgcatacaattgcagaacacgcctttcagttcactttcgaatagcagctcaaggagcagtccaatagctgagaacaacaagaa

SEQ ID NO: 15947 - DNA, 956 bp, Gossypium hirsutum
  Predicted polypeptide sequence is orthologous to G1868
atcttctttgatggacaacaacagcagcaaatgctgagcttttctgctcccaaatcagaagctctttcaatggggaggagttcccaaaatgtcacattcccttactttcatctcacatcaccagcatgtactagaaatacaggctacaatactggaggatttaatggtgcaaatatgaatggaggaccattcacttcatctcaatggatggagctagaacatcaggctttgatctacaaatacatggctgcaaatgtgccaataccatcaactcttctcattcctataagaaaagcccttgattctgctggtttctctagcttttctggtggactcctcagacccaatacatcagtgggatggggagctttccatcttgggttctcaaacaacactgatccggagccaggacggtgtcgtagaacagatggaaagaaatggcggtgctcaagagatgcagttgccgaccagaagtattgtgagcggcatatgaacaggggccgccaccgttcaagaaagcctgtggaaggtcaatccggacgttccaccgcatccaccaccacaactaccaccaagctgatgcattctggctcgtcctcttcagcatcagtggtagggccaaacggtggaaacggtgagtccaacagcctcaccattgcacagcagcaattcaagaatttgcagcctgctggtgaatctaatctttcgcactctggtccactaaacaggtggcttctgaataaagaaagcattggtgaaagaatgcatgatactgctcctgggaatgagtttggagttgtttcttctgagtcactccttaacccttcccacaaaagctcttccctcgttaagtgcattaattttggctgttctcaagatcttgatagtcaagaaaccgaatcacatcgatcagttcgccagttctttgatgcctggcctaaaacccagtccgactg

SEQ ID NO: 15948 - DNA, 945 bp, Gossypium hirsutum
  Predicted polypeptide sequence is orthologous to G1868
ccttttcaaacgcttgttattattcaaagcttcaactcatgcttttcagaggctgttttgattggttccttctccaaaatggattttggggttccggttttggatggtattctgggtcctgaaaacggagctccatctcaacctcagcctaagctagaaagatctgaagatcactgcaagtgttccaagttgcaaagaagtggtgatttactgactcccaagacaaggccattgcatcaaccttctcctttgttgagatctaattctttggtcttagctgacactggcccccatgagcatatgctctgcttctcttcactcaattctgaagttccttttatcaacatcaaagatggtgactttttggagataagtacacaaaacagtggtttttcttactgtcagcctacaccctcctcatatactagaaatgcaggttatggctctggaagcttaagtgcaagcatgcgtgggggttttaatggtgttagaggaccatttactccatctcaatggattgagttagaacaccaggcattgatctacaaatacatcacttctaatgtggcagtgccgtccaatttgctcaaccctctcaagaaggcactttatccttatggcttcaccagctctcctgctggatctttgcctcccaattcattgggatggggctctttccatctggggtactctggcagcactgaccctgagccggagaggtgtcgtcgaactgatggaaagaaatggcggtgctctcaggatgctgttgctaaccaaaagtattgtgaaaggcacataaacaggggccgccatcgttcaagaaagcctgtggaaggccagactggccatgctgcctctgggaccactaatccaaaggtggtgccgatgtcttcctcaatgttgacatcagtgataactgggcagcggtgcatccagcagcctcgc

SEQ ID NO: 15949 - DNA, 936 bp, Gossypium hirsutum
  Predicted polypeptide sequence is orthologous to G1927, G2184
tttttttttttttttttttacattcaaaattagttagatattaaaactatgcatatatgttgtccatgcaataatttcacttcacttcacttccaacttatacatatatatattcaggaggagatagatctccctaggaccctaactgttcctatcaagaaccataagacagcacacaatgcacctaaaatagaaatgaaaaagaatcccctattcctgcttctcctcctagcactagcagaaccattcactgcagtatccattgcatgtattctcaatttactaaagctagacatacgctccaatgcccgatttaccaatggactctcagctgcagaagcaggagccgtaggtattgaatccacaaacgaccacaaagaagatgaaaaccagcttccaccaccactgccatcatttttgttaccttggtcttgcttagggccattgtttacaaaacctgaagttggagaagcattcccaagatttgatcctgatggaatgaaaacatcaccactttgatcatgtgtccaaagtgcaccattaatctgatccatttgcagctgttgattctgcccatggtaatccacctggtccacacttgaatgaagcaccgattgctgatccattgagtttatatttggaccagattgataaaccatctggttcaacatattacccccagacgcattcagttgaggctgcaaatgttgttccatcatatttgcatttgcttggttttgccactgatttatcatattatcatacaagaatggaactgttccttgatcaatagaccccatgtcctgtagaaacatggctgcatcatggtacaggtcaaattcactcagcccatccaactcattgaactgcttgttctccacaggcttctcgatattggagatcaaaggttcaggaccaaggagatcatcctcgtgc

SEQ ID NO: 15950 - DNA, 842 bp, Gossypium hirsutum
  Predicted polypeptide sequence is orthologous to G1927, G2184
tttcacatgataactaaatataaatacggtatttacgacacacaaggacgcctactacaaagaaatttcaaggtacctattatgctttccttctgctaacacttcttcctgagacattaaaaactatttaatttaatgacaaatttggacttcactatgcaacaatttcaccaacttcccagtagaacataactaacaaaacttcccacttacattatatcttcacgaggagatcgaactccttacgaccctaaccatccctatcagaaaccataatatggcacacaatgcacctaaaatagaaaagaaaaagaaccccttactcctgcttctcctccgagcagttgtgccaccattgactatcaacgcattggtgtttctaacattcattctcaacctactgaagctagacattcgctcaaaggctcggtttaccgaaggactctcagatgcagaagcaggagtagtaggtattgaatccacaaatgaccacattgcagtagaaaatcggcttgcaccctcgccgtttttgtcaccctcatcttgattattaccattgtacaccaaacctgaacttgaagaggcattcccaagattcgatcctgatggagtaaagacatcaccactctgatcatttatccaaattgaaccattgatctgatccatttggagctgtcgctccatctcgtttccaaaagattggaatggcaaatggtaatccacctgatttaatataccatcctcgaaggcattcaattgaggctgattatcaccgattgtatttcattgagactgcacctgttgattattccaaaggcattcgattgaaagctgcactgctc

SEQ ID NO: 15951 - DNA, 923 bp, Gossypium hirsutum
  Predicted polypeptide sequence is orthologous to G1927, G2184
ctttgactgcgattttttctcttctattcctaaaaaaaaaaaaaaacttttcgtataatgtgagattaaatttcttgttttgaagtttgggttttgatcagtttttagctctcttgattgggtagttttctgttttttctttgtgtagaaaaaaaaaccaaaaaaagtctctttttttttactatcaagagagatgaaggtgactgcgacggctgtgacggttgattccggttttggggacgaccaagtgtggccaccggggtttcggtttcacccaactgatgaagagctggttctttattatctaaagaggaagatctgtaaaaaaaggcttaagcttgatatcattagggaaactgatgtttacaagtcggatcctgaggaattacctgggaaatcggtactgaagaatggggatcgacagtggttctttttctgtccaagagacaggaaataccctaatggagcaaggtcaaacagggctaccatacatgggtattggaaggcaacgggaaaggatcgttctattacttgcaattctcgagttgttggaatcaagaaaactttagttttctacagagggcgagcacctaatggcgagcgaactgactgggtgatgcatgaatacacccttgatgaagaggaactaaagaggtgccagaacgtaaaggattattatgctctctataagttgtataaaaaaagtggacctggccctaaaaatggtgagcagtatggagctccatttaaagaagaagcgtgggatgatgaggaatattctagtaaccctttagattcaatcactcctgtgaagccacctaatgaggtcattcctgatgataatgtaaaagctaatgttcaatctgagtctccattgagtgatattgaggagtttatgaaacagtttgctgatgagcctgcac

SEQ ID NO: 15952 - DNA, 802 bp, Gossypium hirsutum
  Predicted polypeptide sequence is orthologous to G1927, G2184
ataacctaatctcttctttttcttatggaaaacgccttggtccattaagtctccttccgaattttcttctttgactgccactctctcttttattttttctacccaacccccaaatttgctccagttctttttttaatataatatatatttttctctaattctaaatcatgtgaaataaagtttgttttgtgatcaatttttgctttcttgttgagaaagctttttttttttcaatcataaagaaaaaaaaaagagaatttttttatcatcaagagagatgacagtggcggcgaaagctgcgacgactgattcatgttttggcgaggatcaagtgtggccaccggggtttaggtttcacccaactgacgaggagctggttctttattatttaaagagaaagatctgtagaagaaagctcaaacttgatatcataagggaaactgatgtttacaagtgggatcctgaggagttgcctgcacaatcaatactgaagtctggagatagacaatggttcttcttcagtccaagagacaggaaatatcctaatgcagcaaggtcaaacagggcaactggacacgggtattggaaggcaacaggaaaggatcgtactgttacctgtaattctcggactgttggagtcaagaaaacgttggttttctacagagggcgtgcacctattggtgagcgaactgattgggtgatgcatgagtatacccttgatgaagaggagctcaagagatgccagaacgtaaaggactattatgctctttataagttgtacaaaaaaagtggacctggccct

SEQ ID NO: 15953 - DNA, 893 bp, Gossypium hirsutum
  Predicted polypeptide sequence is orthologous to G1928
gtctttggattttttttcttttttggtttgtaaaaaaccaagatccatggcccatgatttgcaaactctggaggtggtcaagttcattggtttatgtaagagaagatgatgaaaagctttatgttccaccaacagcaacagcaacagcaacagcaacagcaacaacaacaagttttggaagagaatatgtctaatttgacttcagcttctgcatctggtgaagccagtgtttcatctgggaatagaactgaagctggttctaattatcctcaacagtacttcaccactagtcaacaacctcaaactcagccagttaagagaaagagaaacctaccaggcaacccagacccagatgcagaagtgatcgctttgtcgccaaagacactcatggcgacaaatagattcgtgtgtgagatctgcaacaaagggttccaaagagaccagaaccttcagcttcatagaagagggcataatttgccatggaagttaaagcaaagaacaaacaaagaggtgaggaagaaggtgtatgtatgtccagaaacaaactgtgtgcaccatgatccgtcgagggcgctgggggacttgactggaatcaagaagcacttctcgaggaaacatggcgagaagaagtggaaatgtgaaaagtgttcgaagaagtatgcggttcaatcggattggaaagctcactccaagacttgtggcaccagagaatatagatgtgactgtggaaccctcttctcacggagggatagtttcatcacccatagagccttctgtgatgctttagcagtggagagtgcaagagcaataaacccacttctctcccctcatcaaccaggcacagcagcagcatctcacatgaatttacaagtgccccaattcaatccccatga

SEQ ID NO: 15954 - DNA, 739 bp, Gossypium hirsutum
  Predicted polypeptide sequence is orthologous to G1928
ccataacctaaccttgccatggtgtttgactgtgctggttttgttgcccaaacgttgaagaagggtttaaacgatgattaagtgcagctaagttggggaaatctctatggggaaatgctttaagacccaagaaatctcttgtcatcccgtcattccctcccatgttattgctttgggaatgggattcttttgtttttgagagatgatcagtggtgggttcttgaaaatcaatggggtttcctttggtgttccataccctgttgaaagactgttcaaatgatgaagacccgtcaaacccagaagataaagaacacatcatatcatggagtagagaatttggagtagcaacgggtgactgttccatgaaaccagaggtgatagctgttgcagctttattccccaaagatgccaacccatggggagaaccacttccaaggtcttcacgtgggaataaacccagaccagaaccagctgtagacgaggcaaaagacgtggaaccactggttcctcctgacatgtaagctctttgcatggaagccatagccgctactggtgatgattgtaagggttggctcatagtcacacccatttgagctgctttctgcaggagtgctgttgcagacatgtgtggagatgctgtttgggtctggaatggaggaagaagtgtattagaaccagtgttttggctagggttttcgttttgtgaccgtgggtgatctaaaggtttattggtggggga

SEQ ID NO: 15955 - DNA, 987 bp, Gossypium hirsutum
  Predicted polypeptide sequence is orthologous to G1932
ctctttcatggcgtcctcaagggaaggtcactacagaggtgtaaggaagagaccgtggggaagatacgcagctgaaatacgtgatccatggaagaaaacaagggtttggttaggtacattcgacacacccgaagaagctgcactcgcttacgacggagcagctaggtccctccgtggtgccaaagctaaaaccaacttccccacaccgtcttcctcttcttctccgccgccggctctttctcttgatcttaatctcgcttctcataatccccatcgttgggctttagcttcacctcatcaccatcaccgttttgccgccgtcggtgatttccttcaagctggtggtattaaagatatgaactttggtcccgacccatcgtcttcgacgagacccaatgtcctctccgtttcaacttcccctccggtgaccgcaaatggtaacacggcgtcgtttcttgggattgttcgacgtggtttgcctatagatttgaatgagccacctccactgtggctgtgaatgtggtttttcttctctaggcattttgcaggctccctttttaacctttaacccttccttaggcatctttgctacttctgtttagtaattattctgtattttgagaactaagaatcataaaaaaaaacatattaaaaactgaggaccctttgtgtaaatatatgttttttccttaacttatgtatgatttaaaacactttatcagatgtttttatcttcatttttttattttactgcatgaatatgatttaatcgtcgattttaatctgctacccgggaaccaaacagatacagatacagaatctctgtttctaaagccataaaggatgcatctttgttgaggaaaaaagaaaaagcacatgcacgcgcacgttagtgcgagtggggcttggacagttggcgatggcagctaacactgtgtaagttggggggtgtatttagacgtggtacaaaatgcgaaccaaagcgtg

SEQ ID NO: 15956 - DNA, 834 bp, Gossypium hirsutum
  Predicted polypeptide sequence is orthologous to G1946
gcgaatttcgacgtcagcttccccagaaaagccgaatcacgaaaagaaaagcgcctcccgcaggcttccctttcccttttaactccgctctctctttcggccgttaagccgcccgttgtctgtttctaagttccttcctctctattttcttctcatatcaatcctcttttatatttcaaattccacaaatatctaatgccgcaaattaaccctgcctctaaaccctagagtccccccctttttcacttctcggttttattttatactttaattattattattatttctttgattttgtgacgtggaatggatggagtgagtagcagtagcaacaaccaaaccgatgcatcgacgagcggcggaggaacccaaacagcagcacaacctctgctaatgccccagtcagtggcggggcatagtgcaaacgggccaccgcctttccttagcaagacttacgatatggtagatgatcctgccaccgatgccatcgtttcttggagcccaaccaacaatagctttgttgtttggaacccgccggagtttgctcgggatcttttgcccaagtattttaagcacaacaacttctcgagctttgtcaggcaactaaacacctatggtttccgaaaggttgatccagaccgctgggaatttgcaaatgaggggtttttaagaggtcagaaacaccttcttcggaacattagccgtcgaaagcctgcccatggccatggacatcaacagacacaacaaccacatggacagagttcatctatgggtgcctgtgttgaggttgggaaatttgggcttgaggaagaggttgagaggctcaagagagac

SEQ ID NO: 15957 - DNA, 455 bp, Gossypium hirsutum
  misc_feature (21)..(21): n is a, c, g, or t
  misc_feature (114)..(114): n is a, c, g, or t
  Predicted polypeptide sequence is orthologous to G1948
cctcagttttttttttttttnctataaagattgaaatttattacaaccaccaaatgatagagaacagcagggtttaagccttaaaaactagtgttataaagctctacagaggcnaacacaattacaaggaacacataggttgggtagatgacacagaagaggatgaagaacacacgatacaatacggtgagggaaatactaaccaaatatttcggaacatctaagtcatcatcagtctcttgctactaaaatcttctcattactaagatctgtgtgattagtcaagagaaaggtaaaggtggcgtgtggctcaggcattcactagcgagataagcaaatgttatctgcatctttagttagtctctctatttcctcaatctttggttttatgtccttttgacggttgcattgcattcttggtatctgaagcaagattacaactcaggcattcacta

SEQ ID NO: 15958 - DNA, 899 bp, Gossypium hirsutum
  Predicted polypeptide sequence is orthologous to G1950
gttattcctgtattttcatggtatgtcatgaggatgattcgataattggggaatttttggaaggtggatgctggtgattgaaataaataggttaaaaagtcttgaaatttgttgttgatcattgataaagctctcgttttttatcaaaatattgaatttgttgtgataattttgttatttcgggaaggggatagtttgaatccgttctctttttgggggtgttaaagtttgagtttctggacttcgggtaaaccttccgttagggactctgattgggagctgttacggtttatcggaaagtggctacagccacaaccatggggggagttccgactgacaatgtggactttgttgtgaccttggatgcagagagtaggtgttcttcggagtaagccgaaaaactaatagaggaaaacgctatctttgttagttctgcccttcgaatcttcttgttctttaaccttcttctttcccttacttcttcttttatctgtaattttcgcttcaaacatggaaattaatcctccaactaagtcagttgaaattaaagagaaagacctcttcaaagctgcggagaagggcgattcttccatattcaaatccctctcccaagaccaccttaccaagtctgttaaactccggaatgaagacgcccgatctcttctccacgtcgccgtctcctccgcccaccctgaggtggtcaaactactctctgccgccgctgatgaatcagttgtgaatggtatcgatgaagaagggttgggctcccattcactcagccgccagcattggtaatttggaaattatggaaatcctgttgaataaaggagcaaatgttaatgtgaaaaatgatggtggccgcaccgcccttcattatgctgctagcaagggatggttga

SEQ ID NO: 15959 - DNA, 1377 bp, Gossypium hirsutum
  Predicted polypeptide sequence is orthologous to G1983
acggccgggggtccccttatcactcagcactttattcttctctctccattaatcttcattgaaagaaaatcatctttgctttcacccatgaccactgtttatgacccttcacaccatctcacctccaaaaaattgtgtttcaaggaccttgaaatccctccaaggaaaaagcaactccattgttgccacaacgccgccgccatggaacttccccaccacgaagctaggctccacaaataccttccttccaatgaagacgatgacggcaccgatgatccatacggcaccgaccatttccgcatgtacgagttcaaggtaagaaggtgtacaaggagccgtagccatgactggactgactgtccttttgctcatccaggtgaaaaagcccgacgtcgtgaccctactcggtaccaatactcctccaccatctgttctgacttccgccgtggcggtggttgccctcgcggcgatgactgtgagttcgctcatggagtgtttgagtgttggctacaccctacacgttacagaaccgaagcttgtaaagatggtaagaattgcaagcgtaaggtttgcttctttgctcattcgtcacgtgagcttcgtctcttgccggaatcacaacctccatacaaaaactctgacaagaactataaccattgctgcttgttttgccggtccgttacatcgtcgtcgtcgttgtccccaacaagcactctcttgggtttatctcatttctcgagatccccatccctgtcaccgcctctatctcccttaaaacaccagcaaagaacaccaaggtacggcggtgatcgtattagtaaatttggaaccgaaatgacaagcagttacgatgatgttttgttgaaggaagtcatgagttatttaggaaccatgaatttgtccgaagtatcttcaccaatggctactactgcaaatacaaacattccatggttcgatgtttcattcaaaggagctccttcaacggtaagtccttctggttctggtgaatatttcaatggtggtggtgatgatgagaaaaacaatggaaacggtgtcgttttggatcatgatcttgacctcgggtgggttaatgagctcttgatgtagaggaagaagatatatatatatatgatctgcaaagtgtgtatattttatgtgtgattgggtttaaaaagattgctgatctgatgattgttttaaatatttcatattggcaaaccaagttaatttcaatttgtaggcttttttttcttgagagatctaatatgatcttctttttatttatgtacttttgactatgaatatgatgaagtcaaccttctgttcgagaaaaataaagaaaactggtcgggccgcctccgccctctaaatctctaa

SEQ ID NO: 15960 - DNA, 817 bp, Gossypium hirsutum
  Predicted polypeptide sequence is orthologous to G2010, G2347
ggcacgagcaaagtaaatatgaataaggatttcatagctgaagaacttgacaatgacatgcaagaagaagaagaagaaggtgttgggggtgatcatggtttcccagatgatgaaaagaagaagaaaggttatggaaggagaggagccgctggtggcggtggtggggtgtcgccgcctgcttgtcaagtggaaaaatgtgggcttgatttatctgatgccaagcgataccacaggcgccataaggtgtgtgagattcatgccaaggcgccatttgtggttgttgctggtctcaggcaacgcttctgtcaacaatgcagcagattccatgagctaccggagttcgatgaagcaaaacggagctgtcgaaggcggttggccgggcataacgaaaggcgtcggaagagctcagctgaatcatcatcagcagcagaaagttcaaatcgcagagggatgatgatcagtgctcaactgaaagagtctcattacctagctgatgatcaaagagccagagtcaatccaatggcaatccatggcagttcatcttttaagcgttcccaaatcagataaggaagcttaagcgaccaaaacaatacgctccctctcttctgtcatccgatggttcatgtcttgtactattctgtcatccgatggttcatgtcttgtactctgtaccacttactagattttgatggaggattttaataacaatgtcaggcatcaactcgattatcgagatttcacaaagtttgtgttcatgcgaacttgccttgctgtataatgatgataataaccctttatctaaaaaaaaaaaaaaaaa

SEQ ID NO: 15961 - DNA, 650 bp, Gossypium hirsutum
  Predicted polypeptide sequence is orthologous to G2011
attgaaacccaggatctctttccaaaaccttcttcattatcttaaaaaaacgaaatgaatccagacgaagaaaaacgctctccgaattcccttccaaacctaccccaaacgtcgaccttcccttcctcattaatggaactggaaacgttttcaagtggcgtgcctcagcctttggaaattcttcatgggaacccagtgccgccatttttgtcgaaaacgttcgatttggtggaggacacgtcgttggatccgatcatctcttggggtccgacgggacagagcttcgtggtttgggacccggtcgaattctctaagttcatacttcctcggaatttcaagcacaacaatttctccagctttgttcgtcagctcaatacttatgtgcgtattattgcaatagtacagcctacataaaaaaaaatatcgctgatggcatttggttttgtaacttttgtttctctttctttctttctttgattgtttgtttgtttgcctgtttttgttttccgtatttatttttttaaggcttaatctgtaaactggaacctgtaattgtagaagcccgatttgtacacattggttgtaatattctaattatcgaacttttgtacaaagattttgtaaaaaaaaaaaaaaaaaaaaaaaaaaaa

SEQ ID NO: 15962 - DNA, 912 bp, Gossypium hirsutum
  Predicted polypeptide sequence is orthologous to G2071
atttcatttagaaaactgggttttcttttgaataattaatcgactcatatgtagtatctgatttttttaatttttggggggcgtgattgtgtgttctgatctttcaattatttggcttgttaaatttcttgagcacattggaatgttaggtgttactagcacttgcagaacaaaaaaagaaagagttggtctttactttcccttttgtgtttatgtttttttattgtttttcttagttaaagaattcctgtatagatcttgatttttgggtttttcctctttttttttaacgtgtacttcccaaatatagaaatatgtaaatctttcaaactgcatgggatttattttatctgttttattttcattgaagtagtagttaaggacttttatatagcatagtttttaggatcatttctttgacactgttttatacagattttaatggggactaacatgaactttggaagtaacccaccgccgtcaggtgattgcggcgggaacaaaccgccgggcaataacctgttaactagacagccgtcaatctattctctaacctttgatgagtttcaaagcactatgggtggaataggcaaagattttgggtcaatgaacatggatgaattgttgaggaacatttggagtgctgaagaaattcaaacaatggcgtcttccggtggtgtcctagagggaaatggagggttacaaaggcaaggctctttgactctgccaagaacacttagccagaaaacagttgatgaagtctggaaagatatttcaaaggagtattcattggggaaagacggtattggaggtggaggaggcactaataatatgccacaaaggcagcaaactttaggagagatgactttagaggagtttttggtgagggctggtgtggtaagagaggatacc

SEQ ID NO: 15963 - DNA, 550 bp, Gossypium hirsutum
  misc_feature (85)..(85): n is a, c, g, or t
  misc_feature (467)..(467): n is a, c, g, or t
  Predicted polypeptide sequence is orthologous to G2085
tttttttttttttttttttttaaaggaagaaatcatttctaatcttcctacagacaccatgtaggctgtatttcgcaattctggngttacataatgatcggcaatgaaccatatatacagttgtcaaacgaactcaattattacaacaaagttcgacctgtgccccttaaacatcaagttacatagcactcaccacagcagaaggatcttgttaatcatctttcagcagtgcacagtggagttatccccattagatgaagatacaacatctggagttacagttacagcctctgactcgttagcttcagcatcactctgctcagcagtctttacagttggatccgggattgctactgtacaaacctttgaaaggtctctcaaaacacccttatttgcccacttggagtccaccatgcattgcccaagagtccttggaccagcaggtccacgaaggcactcataggagntttctcttagagctgattccacagctgtggtacattaaacttcttggaatattctccatcttgcccagaaaccctaccatgca

SEQ ID NO: 15964 - DNA, 936 bp, Gossypium hirsutum
  Predicted polypeptide sequence is orthologous to G2085
gcgctttcgatttcattgcctgtaaatgcttcctcaatgtacggacaatctcagccaatgaacattccacctcagatcgccggctccggcgctgacatcgacgacgatgtttcagcctccgtatccgtcgataaccaccacatcgttacttacgaggctccctccctcgacgacggtggtggagtagacgacgtagccaccaatcctttctacgccactgccgccgctacttccgcctctggcttggatgttgttccacgaggcgatggtgccagccaactcactctatcgtttcgtggtcaggtctatgtgtttgatgctattactcctgagaagtttcatgcagtgttgttactgttgggtggatgtgaactgacttcaggcccccatggtgttgaaatgtcatctcagaacctaagggttggaatggactttccgagatctaatcaaccgcacagagcagcgtcgctagacaggtttcgcaagaagagaaaagaacgatgctttgataagaaagttagatatggtgttcgccaggaagttgctcttaggatgcagcgtaataagggtcaatttacatcttccagaaaatctgatggtgattatggcagttgtagtcaggatgatgataacctagcagatactgtttgcacgcactgtggcattagctcaaaggccacccctatgatgcgacgtggcccatctggtccaaggtcactatgcaatgcttgtggacttttctgggcaaacaagggtactttgagagatattcccaagaaaactcatgaacattccccgactccagttgagcagggagaaagcgaaccaaatgactcggattctggaactgctattcctacagaaagcaacgtagtacctttctcaaacggggatgactcggctctaatcggcattgccgagcactaatcatccatg

SEQ ID NO: 15965 - DNA, 810 bp, Gossypium hirsutum
  Predicted polypeptide sequence is orthologous to G2110, G2574
gcggccgcgtcgacgtaggtgcaaagatgcgccgaggatatgtcaatcttaattacaacttatgaagggaatcacaatcacccacttccagtttcagcgactgcaatggcttccaccacctcagcagccgcttccatgatgttatctggctcttcaacatctcaaccagggctcaatggattaaacttcagccaccatgataattccacaacaagacagttctatttatccaactcaacctcatcatcattgtccccaacaattactctagacgttacctcttccccctcccattcccctttatcttcatctaattatttcaacagcttccctacaagctttcccagatttcctcgaagtctcaacttttcttcatcagaatccaacattttgcctgcagtttggggcaatggctatcctggttatggtgcagtgccatattatcaaactcagcctggtaactcaatccttggaaacgagtcccaaaaccagatttaccagtctttaccgggtaataatcagcaagggggagcctctcaacagtctttgacagaaaccttaacgaaggtaatcacatcagacccaagcttcagatcagtaatagctgctgcaatttcatctgtggtttgtaacagtgcaaaatctgaagaccaaactgatcaaaaagctcagcattttggtcagaaattgatgcaggccatagtttctcaaaatgagaaaggtcaatcatcatgttcatcaagctacttcaatggattggcatcttcaagttctcaaacaagaagttcattacttcagtcttctttgcct

SEQ ID NO: 15966 - DNA, 981 bp, Gossypium hirsutum
  Predicted polypeptide sequence is orthologous to G2130
ctcctgttcctttccagtatctcgccttttgattttactctccgccaaagttttagtttcttttttcttctctctctcgaaaacagaatccccgtttttctttatgttaaccacctggaaatgaatccagggagggtgaaatacacagagcgaagaactgttactaataagctactcaaggcatcgagcaagtggtttcccatggagtccaagcccaaagcccctaggatcgtcaggatttctgtcaccgatggcgatgccaccgattcttctagcgatgaaagcgagcaggagagacatcacacagtgaaaaggcatgttagcgaaatcaggatcggagattgttctacattcaattccaacaagccatcaaacaagcaaaacagaccgactaacaataagaccaatcttgtcaatatcagatcaaagaagcaacaaccgcagcagcagcagcagcaatgtttgtctaacggcgtcaagtaccgtggggttcgacaaaggccgtggggaagatgggctgctgagatcagagacccgacaagtcgaaccagggtctggcttggcacttatgatacggctcaagaagctgctttggtttatgacagagccgcgattcgaatcaaaggccctgacgctctcaccaactttataaagcctcctgccagaccctccccacctgagattgaacttgaaatgacttccgggtatgattctggccaagaatctcactcactctgttcaccaacttctgttctgagatttcagtcgaatgaagaaactgaacttcaaaccgagtccaaagatgactcaacaacacaaactgggtggagccctgttaaggaactctctcaatacccaagtaacttattagacgagtttttgttaacagatccagtggttttatatgattacttggattctgataaccctacacccatattttttgatgaactgagtttaccggaagcaagcagcaatttg

SEQ ID NO: 15967 - DNA, 901 bp, Gossypium hirsutum
  misc_feature (21)..(21): n is a, c, g, or t
  misc_feature (36)..(36): n is a, c, g, or t
  misc_feature (40)..(40): n is a, c, g, or t
  misc_feature (70)..(70): n is a, c, g, or t
  misc_feature (95)..(95): n is a, c, g, or t
  misc_feature (675)..(675): n is a, c, g, or t
  misc_feature (770)..(770): n is a, c, g, or t
  Predicted polypeptide sequence is orthologous to G2142
acggggcgcggcgggaggggnggtgtaaggggacgntgtncttattttgcaggccacccatgttcgatantcaatcaaactgctatatgttaaancggtacgcctgcaggtaccggtaatgaattcccgggtctacccacgcgtccgggaagcttgatgagaataacaccaatattaaccccacggtgatcacaagtctgccgaatgctgtagaaactgatccaataagatatgttacatccaaaactatggattgccaaactgagttggcgaacagcggaacccatctgcccatccaaggtgagaatgtgcttgtgcatccccttcagagaccagtctctgagactcaatcgactgagtgtcttgttggcaatgatataccgatcaatcaacaggaggatctgactattgaaggaggaacaattagcatctctagtgtctactctcaaggcttattgagcgctctggcacaagcacttcaatgcttgggtttggatttgtcacaggccaacatgttagtgcagattgatcttggaaaacatgcaaatagagggctatctgctaaggaaccacataattccccccatcaggcaatgacccatcttagagatgtgagcagtggagaggattctgatcatgctcaaaagcgactgaagaaataagatcggcacctgngttccataaaagatcatttcaactcggttttcccacctgatctttctttcttgtttcatcttgatttcatttggttattgtatatgctgcagttntggttcttttctagaagtccaagtatcgatcattgtttgttgtaagagtagtcccccttaaattatgtgtattttcatggggggtggtccattagaattctgttaaggtgatgtcaaggcgtttaccttta

SEQ ID NO: 15968 - DNA, 652 bp, Gossypium hirsutum
  Predicted polypeptide sequence is orthologous to G2142
catccacgcgtccgggggaatgcctcttcccatccgaggtgataatatgcttgtgcatccccttcagagaccagtctctgaggctcaaccgactgagtgctttattggcaatgatacagtgaaccaacaggaagatctgactattgaaggaggaacaattaacatctcgagtgtctactccgaagggttattgaactctctgacacaagcactgcagagtgcgggtttggatctgtcacaggccaacatcgctgttcagatcgatctcggaaagcatgctaatagaggactaacatcaggaacatcggctaaggatccacagagtgccccatttcaggcaatgacccatcatagagatgtgagcaacggagaggaatccgatcatgctcaaaagcggatgaagaaatgagatgagcaagttgagaatttttggcttctgttgggttattccttgtgtcattttttaagcttcatttggttaatgtatatgcatgcatttttaatatgagcagtccccatgatgttatctatctatatggagtggttcctcaggtttctgttgaggggatgtcaatgtttgacctctattatcatggatggatgtatcattcatattgttttaaatatataaatttatatttttatccaaaaa

SEQ ID NO: 15969 - DNA, 884 bp, Gossypium hirsutum
  Predicted polypeptide sequence is orthologous to G2142
gcacgagacgggacatccatgaaactcatccacatcacatttctttctccactgctgttctcgccgggaaccaaccaaccaagaaacaccattttttccccttcccattttctctccaattccttcactttttctatcaaaccatccaatcatccttctttttcgatctccccatttttgggttattattttttttcataatatttttggtcgtttgtttttgtcatccggagaaggaaaataaatgagaacaggaaagcaaagtcaagaggaggaagagtacgaggaagaagagtttggttccaaaaaacaaggcccatcttctaatcaaattatgtccggaaacgccattaacaactccaacaaaggtgggaagaacagtgataaggctaacgctataagatcgaaacactcggttaccgagcagaggaggaggagcaagattaatgaaaggtttcaagtattgagagatataattccgaacaccgatcaaaaaagagatacggcttcattcctgctagaggtgatagagtatgtccaatttctacaggagaaggttaaaaaatatgagggttcataccaggaatggaattctgagcccgcaaaattaatgccatggagaaatagtcactggcgtgttcagagttttgtcggtcaacaacaagctattaaaaatggttctgatccggggtcagcatttgccgggaagttcaatgagaataacatcaatatcaatcccacgataatcgcaagtgcacaaaatcctgtagaatctgatcctgtcagagacactatgtccaaagctatggatcagcaaccagagttgggaagcaggggaatgcctctgcccatccaaggtgataatatgcttgtgcatccccttc

SEQ ID NO: 15970 - DNA, 912 bp, Gossypium hirsutum
  Predicted polypeptide sequence is orthologous to G2144
ctaagcttgagctgaccgccctccacgaatctaacccaactttctcgcttcacttctttaacctgttaacactgcaatttgggttgaactaaccaagtggctgctttttattttcctgaattttgaacgtgggtatttttcacacttcccaaattgcctagtcccaccgctctctaatggagtcgaaggcagggacgacggaaaccagatccaacataacggcgtcagacggggaccaagttgcggcactcgaatccctacaatttacagacgaattccaccgtttaatcttggctccgccatctgacaatgcgacttctctcgcggctcttcttgaactcccggcttcacgagcccttgagcttcttcactctccggcttcggctaagcttatcgctgctccggctcccagctttgaagctttaaaaggaaactttctttttccttctaatacctctttgattgatcaagctgcgagatcctctgtgtttgctggaggggttaacaacaccaataacaagagcaacgcgcctgaaacgacgtcgaacaattcaaccttgaatcttgagaaagcagtgaagagtgagccggcggagaccgagtcatctcagccgttggtttctgacccagcggtggagaagcggaatttcaagagaaaggatcgcgaaaagaaggctaaaggttcaacgaagaaaagcaaaactgcggtgaatgatagctcagatggccctgaaaagctgccctatgttcacgttagagctcgccggggagaagcaacggatagccatagcttagcagagagagcaaggagagagaagattaatgcacgaatgaagctactacaggagttggtacctggttgcaataagatttctggtacagctttggtgttggatgaaatcatcaatcatg

SEQ ID NO: 15971 - DNA, 985 bp, Gossypium hirsutum
  Predicted polypeptide sequence is orthologous to G2144
ttaatatctctcaataacaattaacaagttttctattagcttgagctgaccgccattgaagaactaaatcaaagcttgtaaaaaaaatatttgaagttgttaagagttgaaattggggtgaattaaaggtgtgggtgttttttattttaaaagaattgaattgggtttttttcagaatttggattttgggtttgttcttcgtttttctgctatggagtcaaacgcggggacattggagaccagatctaataaaacggcgttggaaagggaggaagtagcggcacttgaatcgctacaatttacagacgaaatccactgtttgatgtcggctccggcgaccgacaatgccagttccttcacggctttgcttgaactccctgctccccaagctgttcagcttattcactctccggattcggctaacctcattgccgctccagctccgaacgttgaagatttcaaaggcgggtttcattttccttctaatggtgggctaattgaacgagcagccaggttctccgtgttcgccggcgaaggtaataacaagagcgactcgcctgaagcgacgtcgaacatttcaagtgcaaatctccagaaggcagtcaagagtgaaccggctgagaccgactcgtctcagccgttaatttccgatccaacggtggagaaccggggtatcaagagaaaagaccgagaaaaggtgaaagggcagacgaagaaaagcaaaacaacggtgaaagagagctccgacgacaccgagaagctgccttacgttcacgttagagctcgccggggacaagcaacggatagccatagcttagctgagagagcaaggagagagaagataatgcacgtatgaagctcctacaggagttggtaccaggatgcaataagatttcgggcacagcgttagttttggatgaatcatcaaccatgtgcagtccctacacgtcaagtggagttcttatcatgagactcgctgcagtga

SEQ ID NO: 15972 - DNA, 801 bp, Gossypium hirsutum
  Predicted polypeptide sequence is orthologous to G2147
ccacgcgtccgggaacaggagactagaggtgaaacaggtcgctcccaggccacaagacggagtcgagcatcagctattcataatctctctgaaaggagacgaagacatagaattaagcaaaagatgaatactcttcagaagctagtgccaaatgcaagtaagacagataaagcttcgatgcttgatgaagtgattgaatacttgaaacaactccaaacacaagtcgaaatgatgagtatgagaaacatggcggcccagatgatgatgcagaagacgcggcggcagcttcaaatgtcggctttagctcggatgggcgtcggaatggggatcggaatacttgacggtaacaactccttggctcccaatccttcaccagtcactgctcccacccacacatttcttcctcctcctcctccgtccttcgtgacaccgccgcctatgattccaacgcgcttcgcggcggctgctcaagcgaattcagatgctagctcacatggctccattccttcgcctgatccgtattgcactttactagctcaatccatgaatatggaactctacaataacaagatggcagcactgtatcgaccacaaattaatcaaactacacagacatcaagcaacccatcgaggtcaaacaatgtagcaaaggattaagatgaagcctaatggtccacccaatttgtgagaagcatatgtatttatgttactcgagcttgaggtatgagtgtaacaatgtgtgcaatacgtgtatgtattttcagacatgcctcactgttttctgatatgtcatagttgaaa

SEQ ID NO: 15973 - DNA, 563 bp, Gossypium hirsutum
  Predicted polypeptide sequence is orthologous to G2156
gtcgacacttaaaaaaaaatcaaaacaaaacaaaacttccttcctttctcattcggctgaaccaaaaaaaagggctcctcattcaatcgtcccttttgcttctctccttggccgatcatgggtttcatcggcgtcccatgcgcctccacctatcgtggctcatggctcgggaacaaaggagacgagaggcgtcccttggtccaaatccatgccgttgaaagggtctccgatggccgaaaccgcgggtaggttcccttccccgacctcaaaaaggtcttcaaggaggtgatgggaccaggtggaggagaggcggtgcaagtggaggcacctagggtttgctgcttgtttttttctgctggtggtttgggctggggtaagttgggtattaatgggcccgggtaaatttgggtacttacaaccaaatttgctccgatcttcttatttgccttcttccagtacatatcattcacttacttataacgcttcctctctccatcaaaacaactctttataattccaagacattgtcctattacttggatgcaaaaaaaaaaaaaaaaaaa

SEQ ID NO: 15974 - DNA, 550 bp, Gossypium hirsutum
  misc_feature (91)..(91): n is a, c, g, or t
  misc_feature (120)..(120): n is a, c, g, or t
  misc_feature (239)..(239): n is a, c, g, or t
  misc_feature (304)..(304): n is a, c, g, or t
  misc_feature (396)..(396): n is a, c, g, or t
  misc_feature (418)..(418): n is a, c, g, or t
  misc_feature (497)..(497): n is a, c, g, or t
  Predicted polypeptide sequence is orthologous to G2192
aatgccacccaacatgattagaattttaattccattaatgggaaaaacaccaactatagaaacccttacaacattcatccacagctatgangaattgatccaagcaacacgaatgtgtcncaatacaaatcaacaagtctctatatcacacactaacactaataaacccactgtgcagtgcccaatatagagtcacaaagctaaggacagcgatcttcaatgcaatctagcaaagttgngttgactctctaaccataccatacaaccggcgattccaatggctgcatagattgtgatcctagcntccactctacagtacaagtggtgagctgagataggtcaatcacacctacgcctctggtgaaaaccaaacgggaggacatcaagactcgggangatcccctagtgatgctctacnagctgtctcatgtcagcgcacgcatgaggaatagaaccttctcctagacgtaacgctacggaattggttgaaacgaaancgcattctggtgctagggccaattttccactctcaaccttgtggggttccccg

SEQ ID NO: 15975 - DNA, 769 bp, Gossypium hirsutum
  misc_feature (637)..(637): n is a, c, g, or t
  Predicted polypeptide sequence is orthologous to G2192
tccacgcgtccgcaggaagtaacacacaagttttggtggatgatcagttgctgggagggaggacattgatccaagaacaacttttccctcaccataatgggctttcaccaagcttggataaaggggcaaacagattcaaaacagggagtggttctagagacgagagtgctgggacacctacttctcatggatcatgccaaggtagccctgcaactgaaagtgccgctactaaggatccacttggtttcagccacgaccaatgctcccccaaattggccttccatttagaggaactgaatatatctacttcattctcaatgccggaagcccctgtgacagcagaacctcgagaaccatttggaggcatgttagtggaggatgctggaagttcgaaagacttaagaaacctatgtccaatagtagcagaaatcggtgccgatgaacgattaccagaatctagttggacaccgccgcaatgttccgaactgggtatcaagcacacaatgcatacattcactcagacaacaccccatgtaacagctcggcatggaatgaagagtgtgaccattaaggctacatacagggaagatataatcagatttcggatctccttaagtagtgggatagtggaactganagaggaagtggccaagaggctgaaactggaggtgggtacttttgatatcaagtatttggatgatgataatgaatgggttttgatagcttgtgatgctgaccttcaggaatgtctagatgtttcaagatcatc

SEQ ID NO: 15976 - DNA, 597 bp, Gossypium hirsutum
  misc_feature (435)..(435): n is a, c, g, or t
  misc_feature (480)..(480): n is a, c, g, or t
  misc_feature (507)..(507): n is a, c, g, or t
  Predicted polypeptide sequence is orthologous to G2226
cttgaaaaagcttacaattttttttatataatttctgttagaaaaaaacccagttcacttttcagttcttggtaccttggctgaccatttttgtttgaattgcaggttaccagggtttagccattgcttttcatttgaagctctcctccccattgtttttaaggtcatatatttattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccaccaccatcatcggattacactgaaaatctctcggaatcattcgatttccaccttaatactcctgaaagttacattgaggaattccggagtatgaccccnacaattcatttcggtgctgttgtatgtagctgcaaacggcctcancacgactgtcaggtgtgtctgactcantttgagccaaaatccgagattaaccacttgtcgtgtggccatctctttcacaaggtgtgtttggaaaaatggttggattattggaatatc

SEQ ID NO: 15977 - DNA, 694 bp, Gossypium hirsutum
  Predicted polypeptide sequence is orthologous to G2226
gaaaagcttacatgtattactttcatgttaaacccagttttcttttccttatgcatcactgatcccatgaaaatttgtcctctttttgtgtcatatatatctgcaagagagtgacatcatttatatccttaactagttcatataatcatttgttcgaataaacttagcttaatcttgatataaaagaatgggtctctcaagtctcccagccccatcagaatgagtgctatgtgtactcttggtaaacacagctttatccatatctatggttaaaggcataattcgatcaatccttcacattatcggtatccatctctcctcgtcctcgtcctcctcctcctcctcgtcatcatcatcatcatcatcatcatcgccatcctcggatcttattgaaatccctgcggtatcattcgacatcagcatcggtaatgctgatagttacattaaagagttccggagcaggattgccatcgacccggtacgatgcggtatgtagcggcagtcaaccggagcatgactgtacagtttgcctgactaggttcgagccagaatcagagattaaccgcttgtcctgcggtcatctgtatcacaaggtatgcttggaaaagtggttgaactattggaatgtcaattgccctctttgcatgaacgctctgctgccagaaaacgaacgggcctacttttgggaagcgtg

SEQ ID NO: 15978 - DNA, 956 bp, Gossypium hirsutum
  Predicted polypeptide sequence is orthologous to G2227
gtaaaaggaaattatgttcactcttttcggaatttagtttccttctttcctcttttttgtaaaagtccccctctttcttgttttgttaatttgtatggcaacgacgacgtcgtattggtgttaccaatgcaatcggttcttcttgatttccaacgaagatccgatcacttgccccgactgtgacggcggattcgtcgaagagatcgataacatgcctcatgcagcgcgtgctttccacgctgactcccgtctcgtcggcggcgatggattcaccgcgatgtacaatagcacaactaccctccgtcgaagccggatgaacggtggcgatcgttctccttttaatcccgtcattgttttagcgtcaccttccggggaaagtacaaatgttgaacagagtgggagggggtttgagctttattatgacgacggaggtggattgggtttgcggcctttaccggcgagtatgtcggagtttctgttaggtcctgggtttgaccggttaattgagcagttatcacaaatggaaatccaaaacattgggcgtcacaaccaaccgccggcgtcgaaagcggcggttgaagcaatgccaatggtggaaatagacgatacccatatcaacaacgaactgttctgtgcggtatgcaaagaacaattcgacttaggaaccaaagttttaaacatgccttgtaaccatttgtaccattcaaactgtttactcccttggcttcgattgcgaaattcatgccccgtttgccgccatgaattgccggcagctataggggaagaaggggacgggagttcaaattcattggatgagacccccatggggttgaccatttggagattaccgggtggtgggttcgcgggtggggaggttttcagctggagagaatagagagtttcccgttgtttatacggaaatgggatggtggttttagcgggagggttggtgccgc

SEQ ID NO: 15979 - DNA, 853 bp, Gossypium hirsutum
  Predicted polypeptide sequence is orthologous to G2227
tcttctgcccccaaaatgtttcctcttttcggaaattagtattcaatttccctttacttctgttactatggactcaacgacgtcgtattggtgttaccgttgcagtcgattcgttcggatttttaaccgagatcccatcgcttgccccgactgcgacggcggattcatcgaagagatcggttaccatcctcacgccgaatcccgtcgcctcggcaccaatagattccaagctctctccaggtataccagctctactcctgcttccactagtcggtctcctttcaatcccgtcattgtcttacgcggcggagcctccacttcctcaaccgtcggggagcattctaatgttgagcatagcaggggagggtttgacctttattacgacgacggtggtggggcaggtcttcgacccttacccccgactatgtcggagattctattaggttcggggtttgagggactacttgaccagttatccgaaatggaaattcagaacatcgggcgttacgaaaacccaccggcatcgaaagcggcggtggaagcaatggcaacggtggaaataaacgaaacccatattctcaacgaacttcactgcggggtttgcaaggagccattagacttgggaacccaagtccgaaacatgccctgcaatcatttgtaccattcggagtgtatactcccatggcttgagttacgaaactcatgccccgtttgccggaatgaattgccggcagaaaccggtggtaggtatgcggaggaggggttaagtatttggaggctaccgagtggagggttcgcggtgggaaggtttacaggcggaagaatgggaagggagaatagagggttgagcgtc

SEQ ID NO: 15980 - DNA, 883 bp, Gossypium hirsutum
  Predicted polypeptide sequence is orthologous to G2227
aaatgttttctcttttgggaaattagtattcaatttccctttacttctgttactatggaatcaacgacgtcgtattggtgttaccgttgcagtcgattcgttcggatttttaaccgagatcccatcgcttgccccgactgcgacggcggattcatcgaagagatcggttaccatcctcacgccgaatcccgtcgcctcggcaccaatagattccaagctgtctccaggtataccagctctactcctgcttccacaagccgtcgtaaccgcggcgatcggtctcctttcaatcccgtcatcgtcttacgcggcggagcctccacttcctcagccgctggggagaattctaatgttgagcataacgggagagggtttgacctttattacgacgacggtggtgggccaggtcttcgacccttacccccgactatgtcggagattctattaggttcggggtttgagggactacttgaccagttatccgaaatggaaattcagaacatcgggcgttacgaaaacccgccggcctcgaaagcggcggtggaagcaatggcaacggtggaaataaacgaaacccatattctcaacgaactttactgcggggtttgcaaggagccattcgagttgggaacccaagtccgaaacatgccctgcaatcatttgtaccattcggagtgtatactcccatggcttgagttacgaaactcatgccccgtttgccggaatgaattgccggcagaaaccggtggtaggtatgcggaggaggggttgagtatttggaggctaccgagtggagggttcgcggtggggaggtttacaggcggaagaatgggaggggagaatagagaggtgagcgtcggaggggaaagaggaggggttctgg

SEQ ID NO: 15981 - DNA, 838 bp, Gossypium hirsutum
  Predicted polypeptide sequence is orthologous to G2227
agcatgtcttcaacgtcttcgtattggtgttacagctgcacccgtctggttcgtgtggtggttttggatagcgggtcaaacgacgccgttgtctgcccgtactgcgacggaggcttcatcgaggagatcgaatcttcggacaatcacaaccgtcggtttccagctatgtacatgatcaccagcaacgataatagccgtcaaaattcgattcgggcgcgaaatctcgtctttcgtaggaatcgtcgcggttctgttgaccggtcaaacatcaatccgatcatcgtcctccgtggctccaccgacgacgagaacggctccaccaacgggatcagcaacagcgggtttgggttcttctatgatgacggatctgggtccggtttaagacccataccgacttcgatgtccgaatctctaatgggtttgggtttcgaccggttattggaacagctttcccagatcgaaataaccggactgggtcaacccgagaacccgccggcttcgaaatcggcaatcgaatcaatgccgacgattcaaatagaaaaagcccatgtttgttcggaaacccactgcgccgtttgtaaagaacctttcgagctcgggtcggaagcgagggagatgccgtgcaagcatatttaccatgaagattgtatcatcccatggctggcgcttcggaactcgtgcccactttgccgccacgaattgccgtcggatcggagcgagtcgaacgacgaggcatcagagacggtggggctgagcatatggaggttaccgggtggggttttcgcggtgggaaaggttcaggggagaaagggaagtgccggtagtatacacggagatg

SEQ ID NO: 15982 - DNA, 954 bp, Gossypium hirsutum
  Predicted polypeptide sequence is orthologous to G2239
ctcctttcctcaccatgtcgtacaccacccaccatggagtcttctcgcttttcttcttgctcttcctgctcctctccccgccgccgtccttcgcacagaacttcaaccaagacgaagaaaattacgctcgtttcagcccttccatggccgtaatcatcgtcgttttgatcgccgctttgttcttcgtgggtcttttcgccatttatattcggaattgttccgacgtgtacaccaacagacagagcatccgccccgtcgccgggcgttcattgcgcggcacgcgtgggctggacgcgtcggtgatcgaaactttccctatcatggtttactccgaagttaagggtcataagatcggcaagggagctttggagtgcgcggtttgcttgaacgaattcgaagacgacgaaacgctgcgtttgatacccaaatgcgaccatgttttccaccctgaatgtatcgacgcttggttagcttctcataccacttgccccgtttgtagagccaatctcgttcctcaaccaggtgaccccgtgagtcaactcactgcattaaataacactgccgtcgagttagaccttgaggctcagaacaatggcagtaactcagaaccggaagaagaaaggagcataaataacaacgctgttaattgtcaggtagaggctcaagtggcttcggaggttgaagtgaataatttgaatgtaactttaaataggaaccgtacacgtggatcaagatctggccgtccacgtaaactttctttcttgcgatctcactcgaccggacattctttggtccaaccgggggagaatacagatcgattcactttacgattaccagttgatgttcggaaacaattaatgaaccgaaagttgaatcgggcgacaagcttagtgttgcccagggaaaggagttcacgccgagggtaccgagcatcagaagatggagggagtaata

SEQ ID NO: 15983 - DNA, 891 bp, Gossypium hirsutum
  Predicted polypeptide sequence is orthologous to G2239
tggaattatctccttccatttcttcgtcctcttgctcctcatctctccgccaccttccactgcccaagtccaacccaccagcccaaacgacgaacaatactcttacgcgcgtttcagcccttccttggccataatcgtcgtcgttctaattgctgctttgttctttttgggtattttctcgatttacatccggaactgctccgaatccaacgccaatggaagcagcgtcaatcctgttaacggcgaagccggccgttcgcggcgtgggacgcgtggacttgaagcgtcggtgatcgagactttccccaccatgatttactctggagttaaggttcataagatcggtaaaggagctctggagtgcgcagtttgtttgaatgaattcgaagacgacgaaacgctgcgtttaataccgaaatgcgatcacgtttttcaccctgaatgtattgatgcttggttggcttctcatacgacctgccccgtttgtagagctaatctcgcttctcaaccaggtgattctggagtgagtcaacccactgagttgaatgagatcgccaccgagatagacctcgaggctccgaacgacagcagtgactcggaaatggaaggagaagaaaggagaataaacaataataatgtcagcagtgacgtagaaggtggtgttgctctggaggttgaagtagttgacttgaacaaaactttaaataggaatcgtacacgtggatcaatatctagccgtacacgtaaattcttttttccgcgctcccactcaactggccactctttggtccagcccggtgaaacaccgaccgatcaccttacgattgccggctgatgttcgaaaccagttaataaaccggaattgaaccgggcacgagcttggttttgcta

SEQ ID NO: 15984 - DNA, 942 bp, Gossypium hirsutum
  Predicted polypeptide sequence is orthologous to G2239
gttctccaccgccaaacatggaatcgttttcgttcttttcctactccttttcctctctccgcctccctccaccgctcaacctaccgacccgaacaacgaccgttacccttacgcccgtttcaccccttccatggctatcatcgtggttgtcttgatttccgctttgttctttatgggttttttctctatttatcttcggaactgctccgaagccaacgccaacggaagcgtcgtccgccctttcaatggcgaaactgggcgttctcgccgtgggatgcgtgggcttgagccgtctgtgatcgagactttccccaccatggtttactccgaagtgaaagttcataagatcgggaaaggagctttggagtgcgcagtttgcttgaacgagttcgaagatgaggaaacgctgcgtttaatccccaaatgcgaccacgttttccaccctgattgtatcgacgcttggttggcttctcatactacctgccccgtttgtagagctaatctcgctcctcaacccggtgaccctgtgagccaacccgccgagttggataacaccaccaccgagttggacctcgaggctcagaactacgacgatgactcagaactggaagaagaaaggaggataaatcctaataatattaactccgatgcggaggctcaagttgcgccggaagttgaagtaattgacttgaaccgaactttaaataggaaccggacacgtggatcaatatcaagcagaacacgtaagttctttttcctgcgatctcactcaaccgggcactctttggtccaaccaggtgaaaacacagaccggttcactttgcggttaccgggttgatgttcgaaaacagttaataaaccgaaagttaaatcgagcaacgagcttggtgttgcctagggaaagaagctcagacgaggataccgaacggagaagacggtggt

SEQ ID NO: 15985 - DNA, 644 bp, Gossypium hirsutum
  Predicted polypeptide sequence is orthologous to G2290
tgccattgttatcactacatatgaaggtcaacactgtcatcacggtatcgcattccccagaggtggactcatctgccatgaagctgcctttgctggtcaattgacaccgccagtctcacaaatttatcatccaggggtgcagtcacataggcaaatgcctccgagcataacacaatcacagccgcaccaagcacccgttgacgtaggagaaccacatccggagcctgaacccacctcacagctccccacagatgaagggttactcggtgatattgtgcctcctggaatgcgtggcagatgagaaagagaatatggcctgtaattgatgggtataaacataagggcagccaagtcatgcgacacaatacttttctcaagatggaagtgagtcatttacctgaaaaggttcacacagatgattatatcataaattattattatatttacttacacaagctcagctataatgcttgcatgaggtcattaatctcttatggtgcccagattttatctaatctcaacccttcaattctaatctatgcatctgaatattgaaattcctgttggttaggtttaagagattaattactgcagatcatataaaagtagtaacattacttgctattaaaaaaaaaaaaaaaaaa

SEQ ID NO: 15986 - DNA, 909 bp, Gossypium hirsutum
  Predicted polypeptide sequence is orthologous to G2311
aaaaactaataacaaaaaaaataattaaaaaaaaatcctttgctgccgagtggcgctcactggcagcagtagcggcggctgccggaagcaaaaaaatcgtgtagctcatcgtcgtatgtgatagtgagatggggaatccaaagcagaagtggacggcggaggaagaagaagcattaagggcgggagtggctaaatacggcaaagggaattggaaattaattcaaagagaccctgagttaagccctttcctctttgctcgctccaacattgatctcaaggacaagtggcggaacttgagtggtggtcccggcggccatggttcacgggaaaaatcaagggcgtcgaagcccaagccgagctccgacggttcgcagggcgctgttgttgttaagcaaactgcattgcctaaaccacttgttgatgattcttcgaaaagctttgctccaaaccggtacaatgaaatgattattgaagccatatcagcgttgaaagagccaaacggatcagataacagagcgattgtcggctacattgagcaaaggcaagaggtacctcaaagttttaagaagcagttatgttcaaggttgaaaaggctggttgctatagaaaaactagaaaaggtgcaaaatcggtacaagatacgaaaagatgagacattcgggatgaagacgacaagcccaaaacaaaaaggcacgaagcttaagcagtcgcaaaatgctggtcatacaacttgcgatgcagttgaagaagcttcaatgactgctgcctatcttattgctgaagcagaaaataagtcatttgttgcagctgagcagttaaagagcagaacgagtctcgaaatggctgagatgcagatcactactacagttggccaagagattttgaacatgttctcaagtgaaatgtgct

SEQ ID NO: 15987 - DNA, 901 bp, Gossypium hirsutum
  Predicted polypeptide sequence is orthologous to G2319
ctcatattgtctactgttaggtagcaaaaaggcaaagccaagccaagcagaggaaaacatgaactcatcacccaatcctccacaaccccctccgccgcagtcttccacttccaccaccgccactgatggctccggcaagaaagtcaggaaaccttacaccattactaagtcgcgtgagagctggactgaagaagagcacgacaaattccttgaagctcttcaactgtttgatcgggactggaaaaaaattgaagattttgtcggttcaaagacagttatccaggttttaagaatggagatttgatgttttgtctttgatcttagtttttccatcgtttatctcattctgcttctgcctttttcagattcgaagtcatgcccagaaatactttctgaaggttcaaaagaatgggacgattgcgcatgtgccgcctcctcgtcccaagcgcaaagctgcacacccttaccctcaaaaggcctccaaaaatgtgttagtgccattacaagcatccatgggttatccttcatcgataaataccattgcacctggatatgctccctgggatgaagcttccatgctggtaaacactgcctcaagtaaaatcatgtcaccacaagatgaatttacaggtcttcgaggaacggaagctaatattggatcgaagggcgtagctaagattagtaacagtggtgttagtggcattggaagctcaggtcaaacaatatctaattccgatatgtcaaagcaagggaaacaagcgtccatgcttcacggtatacctgattttgctgaagtgtatagcttcattgggagtgtctttgatccagacactgatgggcacgtacaaaaactcaaagagatggatcccataaattttgaaactgttttgttactgatgag

SEQ ID NO: 15988 - DNA, 581 bp, Gossypium hirsutum
  Predicted polypeptide sequence is orthologous to G2343
ccctaaattcggctttcgagcggccgcccgggcaggtactaccttggatgaagaaggtggtggagaaatgacacttgagagcttaaggagacaacaacaagagttgaatgaatgggttgaatcacaacaatgttcaagctttttgttgtgggataatattattgaaggacaaattggtggtagtgttgaaggaacaacaataccattaccaccttcatcttcatcatcatcaaatatgggaactacactatcttctttcccttcgtctctataaattatcattaatggtgatgatttgtttttctttctttcttttttgcttcttttgttaactttattaattggtcatgagcttgtggaaaatgtgagggaatgttgcatatttaagtatgcaccattttttttctttcttatcggtgtttggagaaatggaaaaggaaagaataaaaagcaatgtaacagctaattagataatttttactcatttctttcggatttttttttatatataaggtattctcggttgatcaaaaaaaaaaaaaaaaaaaaaaaaagtacctcggccgcgaccacgctaagcc

SEQ ID NO: 15989 - DNA, 552 bp, Gossypium hirsutum
  Predicted polypeptide sequence is orthologous to G2343
gcttagcgtggtcgcggccgaggtaccttgcgtgggcggaactaaagtctttcgtatcttcttcttgatccatgaattccaatagtttttaatctcattatctgttcttccaggcaagtgacttgctatatgagcccacctgtttcctacaaccccatggaggctaatgatcaacttctcttcctcaggtgtaaaccttcctcttcttatatcaggccttaaataattaatccatctcagcctacaacttttcccacatctctgaagaccagctttctcagggacttcactccaacatccatagccatgagtggtgatgaacctaatgagcttttcatcttcctcaggggaccaaaggcctctcttaaccttttgttgattgcagcaagaatggtgacccatcctgtataatttaatatggacgacgacgatgatgataaataatatcaactaatcttctgcttacttaattttaattcacaaattaaaagaaaggaaagaaatagctctttgggatttccccgcgtacctgcccggcggccgctcgaagcc

SEQ ID NO: 15990 - DNA, 905 bp, Gossypium hirsutum
  Predicted polypeptide sequence is orthologous to G2371
ggacctctcacttctaccccgccatgttcctatcctccatccacgctgcccgccacttcagccttaaccatgacgacgacgaagagctcgacgaccaaacatccaatctcgacaccctaaaccctaaaccaaatccccctgaaaaccaccagctaggccatgaaacggaacccatgtttgaaaagcccttaacccccagcgatgttggcaagctgaacaggcttgtaatccccaaacaacatgccgagaaatacttcccgctaggcagtgactccagtgataaaggcttgttgctaagtttcgaagacgagtcaggcaagtgttggcgcttccgctactcgtattggaacagcagccaaagctacgtgttaacaaaaggatggagcagatacgtcaaagagaagcaacttgatgctggtgacattattttattccaacgacaccgcacggatggtgatagattgtttatagggtggaggaggcgcggtgcagcagtggtggttgcaccggcggctactgatggcggaaacgccgtgatggagaataatggcggtggtggtgggggtggaaatggaggggtggagtaataggcgattgtatcaaaggtatcctcatcttggacacattcaaggtcttgaggctatttggagtgaacctagaatgccaccagctagacgagtccccaccatccacgcctgctagctcgatggtgtcgagccagggtccaacagcccaccagttttactagttttccctcctacacttgaaactacatggtcaggaatggatatcgtcccgagacatgaagcggatgaaaaagatgagggagggataagatctgaagatgtgacatccaggaattgactttgaatattgaaaccccacttggaacgtcacaattagag

SEQ ID NO: 15991 - DNA, 470 bp, Gossypium hirsutum
  Predicted polypeptide sequence is orthologous to G2382
catatatgaaaaaattgagaatagtaaaaggcagcagatgttggaattggagaagatgagaatggattttcacagggagttggaaatgcagaagaggcagatcatggagagagcacaggctgaaattgcggaactacagcatggtgagaatgaggcgaatgatgcctccggtgagaatgctagtgggtaatatatgcaaaacccagttatcttctttataacattcatcagattttggctgttaaatgttgttgtatggtatatgggagcctgttgccaaatgccgttgtgataaacaataataacacggtatacatgctgttatcatccaaaatcaagtagaaacttgtactgaatttagtgaagatcattactcccattccatgttatagtttaactgatgcgtcattttttcaaggtgaatgaatggccaagtgcctagatgtttaaaaaaaaaaaaaaaaaaaaaa

SEQ ID NO: 15992 - DNA, 653 bp, Gossypium hirsutum
  Predicted polypeptide sequence is orthologous to G2404
caaacgttgaggttcatcaattagttcatttaggacctttgtttgcccggcaaatcagatttttggtggtaatggtggttggtgcagacaatgatagtacgtaatatgcttatgggggaaagaatacattcaagagaccgatttagcaactggaggcttgatattgacaacatgtcatatgagcaattactggagcttgcagataagatagggtatgtccacactggattgaaagaagaagagataagtagatgcataagtaaaattaaggggtcgatgaagaatgatttagcaccaaacaaacccatgcatgtggataacaagtgcagcatttgtcaggaggaatatgaagatgaaggagatgaagagatggggaagctatgttgtggacacagttttcacattcaatgtataaagcagtggctgctgcagaaaaatgcttgccctgtttgtaagactgaggcatcacctcgatgatagcagcagcagccatggatggattcaatttaacccacttgttggtggtttacttactgtttcatttattttagtttagtccaaaattagcgtttatatggatgacaatggtagcaactttgcctccaaatcaaatatgatggtgattgttttgcttcacaaaaacaaaaaaaaaa

SEQ ID NO: 15993 - DNA, 514 bp, Gossypium hirsutum
  Predicted polypeptide sequence is orthologous to G2457, G2459
ggttccacaatccgagcatctttgctatgtccgctgcaacttctgcaacactgttcttgcggttgggatcccatgcaaaagattgcttgaaacagtgacagtgaaatgtggtcattgcagtaacctttcttttctcagcaccagacctccactgcaaggtcaatgcctcgatccccaaaccagcctcactctccagagtttctgcggtgatttcaggaaaggtactcagtttccatcgccatcttcatcaacatcgagcgagccatcatcccctaaagcgccatttgttgtaaaacctcccgagaagaaacacaggcttccatctgcttacaatcggtttatgaaggaggaaatacagcgcattaaagcagcaaatcctgagataccccatcgagaagctttcagcgcagctgctaaaaattgggctcggtacatcccaaattctccagcagcatcatccgtttgtggaagtagcagcaatggcttctatgaaaattttgcaggaacaaaatga

SEQ ID NO: 15994 - DNA, 851 bp, Gossypium hirsutum
  misc_feature (718)..(718): n is a, c, g, or t
  Predicted polypeptide sequence is orthologous to G2465
gcggccgcttcgacggagaaacgaggaagaagaaaaaagttttaagtaaaaaaaaggattttttttatagaaaaaagggtaatgatagagatggattacgctctgaaaaagcgcagatgtcacgaatatgtagaagctttagaggaagaacgacgtaaaattcaagtctttcaacgcgagcttcctttgtgtttggagcttgttaaccaagcgattgaagcacacaagaaagagatgtcgggaggttcaaccacgacggattacatgcaaggacaatcggattattcggagcagacaactagtgatgttcctgttttggaagaatttattccgatcaaaagaagctctaattgctctgaggaagacgatgaacaagaatcgcataaatccaaagaaaccaatgttcctgctgcttttgataaaaggaaatctgattggcttagatccgtgcagttgtggaacaacaatcaatccccagatctacccttgaatgaggatgatgataaaattggaagtgcgatcgaagtgaagaaaaacgggggagcatttcaaccattccagaaagaaaaaactgtagagatgagtggtcaatctgcagtaggaaaaaccaatggctcagctacaagtacttgtacaacagaaagtgggagtagaggaggagaagccaataatgcaaataaaagtaaaacagaagaaaaaggtggtcaggcttcgaganagcaaaggcggtgttggtcaccggagttgcataggcgcttcttgcatgctctccagcaactcggcggttcacacgtcgcaacaccaaagcaaattagggagctgatgaaggtcgatggacttacgaatgatga

SEQ ID NO: 15995 - DNA, 874 bp, Gossypium hirsutum
  Predicted polypeptide sequence is orthologous to G2465
aaaaaacatcacaactaattcccttgacttagcttctctcatcttgttcggatctctctatgctctttggtctgaaaccaaccctttcccctcacatatatttatatcatccactgtgtctgaaaatcctcggtgtggaagaaataaaattacttttttaagtaaagaaaatttccttgctatgatagatatggattacgctcaaaaaatgcgcaaatgccatgaatatgtggaagctttagaagaggaacgacgtaaaatccaagtctttcaacgtgaacttccgttgtcttttgagcttgtcacccaagctattgagtcatgcaagaaagagatgtacatgcaaggtcaatcggagtgttcggaacagacatcgagtgacagtcctgttttggaagaatttatccccatcaaaagaagctgtaattgctctgaggaagacgatgatgatgatgatgatgatgatgttgctgctgctgataaaaagaaatctgattggcttagatctgttcagttatggaatccaccctccaaagagggtgtgggcaaaactggaagtggggtacaaatgaagggaaatggtggagcatttcagccgttccataaagaaaaaggtaatgtagagaagaagagcgttgaagcagtaggaaaaggcaatgcttcggctacagcaactactactactacgagtgcttctacgacagaaagtgggagcagaggaatagcagccgacgatggaaatactgataaaaaagtagagaaagggcagcagcagcagcagccgcctcagagaaagcaaaggcggtgttggtcgtcggagttgcataaacgcttcttgcatgctcttcagcaactcggtggttcacatgtggct

SEQ ID NO: 15996 - DNA, 864 bp, Gossypium hirsutum
  Predicted polypeptide sequence is orthologous to G2520
ggatccgccagctatgatgagcgatggaaggtacaatctagcagagatctggcagtatcccatgagtgagtctgggataagtaggggtcagttcggacatgggttggctcagttcggggaccccagtcgagaggtttccggcaatgatccgggtagcttggagcagcagcagagaaggggtggtatgaggagaaggcgtgacggagaagttgaaacagctaaggttgtctctactagctccactagtagtggcaatgccgtgaataatggtgaggggaagagaattaaagcagcaggaggcagagaacaaaatcatgaatctagagttgaagcagaacccagttcaggcaagcttgtggaagaaaaagctcaaccttccgagccacctaaacaagattacatccacgtacgagcgcgaaggggtcaagctactgatagccacagcttagctgaaagggctaggagagaaaagattagtgaaagaatgaagattcttcaggatttggttcctggttgcaataaggttattggcaaagcacttgtccttgatgagataattaattacattcaatcactacagcgtcaggtcgagttcctatcaatgaagcttgaagcagttaattcaggaataaaccctgccattgaagtatttcctcgtaaagattatggccaacaagcgtttgatgctactggtatggcattcggttcgcaagtgataagggaatacagtggtggcacatcaccagagtggttgcacattggcagtgctttcgaaaggacaacataatcgggtaaagggaatccccttgcaattaaataagagcattaaattaatttgcagtgcttccagcttgggtcggccaa

SEQ ID NO: 15997 - DNA, 924 bp, Gossypium hirsutum
  Predicted polypeptide sequence is orthologous to G2522
aaaaaaaaaaaaagcttgcctcctctcaaccttcacacaaaaatggcttcttttcaccatttctagtttcccattgatttccccttatcttttctctcttttcaaaagaccccctttttcttcaaagcttcttactttcagaaggctgcacctttaaccacagttcaactaatgtacattcaagtattcgttttttgaagtagatgcatggatagaagggatacaatggcattaacagggtctgcatcttattatattcaacaaagaggcataactgggtcagggatacatggatcacaagacattcatatgttatctagtccaaatgtacaataccaatcaagtatgagtgctactactatgggacctgtggagagtattacccctcatagtgtcaatgtaggcacaccttcagctgttccatctagtgagaccacgaaacggaaaagaggaaggcctcgaaagtacggtcccgacggaaccgtttcattggcattgactcctccatcggttactaatccagggacattaacaccaccgagtcaaaaacgaggtagagggcgaccaccgggtactggaaagaagcaacaacttgcttcccttggtgtatggctgtccggttcagccgggatgggtttcactccgcacgtcatcaccgttgccataggagaagatattgcgaccaaattaatgtcattttcacagcaagggccaagagccgtatgcattttatcagccaatggggcggtctcgaccgtaacacttcgtcagccttcatcctcgggtggaaccgttacatatgagggggcggttcgagatactatgtctgtcaggctcgtaccttctaaccagcaataatggctcacacaatcgaactggtggtcttagtgtttcccttgctagtcctgatggtcgtgtcattgg

SEQ ID NO: 15998 - DNA, 923 bp, Gossypium hirsutum
  Predicted polypeptide sequence is orthologous to G2522
tttctctctctgcttttaattcccttaacctccgtcaatctttcctttttgaaaacaagttgattttgaaggcatcattcaagtgtataggttattggaggtgaatgcatggatcgaagggatgccatggcattatcagggtctgcatcttactatatgcaacaaagaggaataaccgggtcagggtccgaacctgagtctgggatacacggatctccaggcattcatccgttctctagtccaaatgtacaataccaatcaagtattccagtcactactgtgggatcaaccttagctatggagtctccatcaggaatcgcccctcatagtgtcaatgtaggcacaccttcagcacagccatctagtgagacagtgaaacggaaaagaggaaggccacgaaagtatggtcctgatgggactgtttcgttggcgctgactcctgcatcagctcctcatcccgtgaccacaacgccgggccaaaaacgaggaagagggcggccaccgggtaccggaaggaagcaacagttagcttcccttggtgactggctgtccggttcagctgggatgggttttactccacacgtcatcaccgttgcagtaggagaagacattgcaacgaagataatgtcattttcgcagcaagggcctagagcagtatgcattttgtcagccaacggggctgtctctactgtaactcttcttcagccatcatcttcgggtggcactgttacatatgaggggcgattcgagatattatgtctatcaggctcttacctgctgatcagcaacaatggctcttgcagccgaagtggtgctcttagtgtttcccttgccactcctgatggccgcgtcattggtggaggtgtcggagggatgcttattgcagcaagcccggttcacgtgattgtcggaagttttcaatg

SEQ ID NO: 15999 - DNA, 809 bp, Gossypium hirsutum
  Predicted polypeptide sequence is orthologous to G2536
gctaagtaccggtcagagatggcggtggccatcggttttcgcttctttccgacggaagaagagttggtttccttctacctacgtaaccagttacaaggcacgagacaagatatgcaccttgttatcccagtcctcaacattttttacgaccttgagccatgggaccttccaagtatatatatatatatacactttcttcactgatcacaccaacatgatgaatcccactgtaagtaggtaacctttttttgtttatggttgcagagcttgctggggagctttgtaaaggagacgtagagcaatggttttactttataccaagacaagagagggaggctcgtgggggaagagctagccgaactacagcttcgggatattggaaggcgacggggtcttccggctttgtctactcgtcggacgatcgactgatcgggatgaagaaaacaatggtcttttacaagggaaaagccccaaatgggaggaaaaccaaatggaagatgaatgaatatagagccatcgaagcactgtccgacccatatgtggctgctcctccaaagttgagacatgatttcagtttgtgtcgagtctatgttgcatcgagcagctctcgagcattcgatagacgcccactagaagcacacaacaatgctgcaacaacttccgggggagcctcaggaacttcacatgctggaggagaccactataatccagccgaggctagtgaagatgagttttgggaattgattaacaatcttgaagaacatgccataggatgggaacaacttaatgaaatataaataggcaatcag

SEQ ID NO: 16000 - DNA, 820 bp, Gossypium hirsutum
  Predicted polypeptide sequence is orthologous to G2559
gcttagcgtggtcgcggccgaggtactttttttttttttttttttttttttttttttacaaataggaattaatgtatttcacaatatatatttgtatatatacacacatagataatgattaaaaaccaatattagaatgtctttgacaattacaaaccaacaagaggaaaagtaataagaaaacataggcaaagaatcaaactaaattcgaggaagaaaaatgtgtcctatatatgaaacattagttgaggatgttaactaccgaaacagccaagaaatttctttggtgtatatccagttgaacgaaacttggctgctgtttcctctatcttaagaaaatcttcacctttcttggcttcgatcatcgctcttctttcttcagcttgtttatggagttgagccactttgtttttcattttctctgcatattcttccttcttcttttccagtttttcctcaatgctctttagctgcgcttctacagcagatttcttggtattctcccatgatccaatagcagatatcttcttatatgccttgttgtctatttttgccttctcattttcctcccatgctttaactaaagctagtcatttttctgtctcaacttgagcaagcacggaatctctgttgtttggacttttctctgtaactgatggtggtgtttctgctgctgcaactttttgaggaagagggatgatcacactcttcttctctgcacctgcttcatcttcattctccatctcttcttccttaacaggctgtggctgttgctgctgctgctgcatgtcctccttgggttcagaggctccattttatt

SEQ ID NO: 16001 - DNA, 550 bp, Gossypium hirsutum
  misc_feature (19)..(19): n is a, c, g, or t
  misc_feature (26)..(26): n is a, c, g, or t
  misc_feature (162)..(162): n is a, c, g, or t
  misc_feature (188)..(188): n is a, c, g, or t
  misc_feature (431)..(431): n is a, c, g, or t
  Predicted polypeptide sequence is orthologous to G2559
tttttttttttttttcccnttgttgncaaatcaacgaatacgatggtagattaaatattggtgatgttacacacggtttacacacaaaacaaacatagaaaccgacaagaaatatacagatgaaaaacgcgaagcttcaaacaacagtcaaaattcacattngcttcaacctcagaccccaaactttngaacttcagaaacacccgaggacctttttgggagttggtccggtgcacggtattttggcagccatttcctccgccttgagaacctcttctcctcgttgggcttcaaccatggccctcttttcttctggcttcctggtgaagcaaagctaccttggtttttcattttctctggcatattctggctttcttcttttccaatggttcctcaatttttttcagtttggcttccagagatgctttctntggctgttactcccatgctacaatagcagagagctttttctgggacttattctctggcttgggtcttttcactttcttcccatgccttgatgaatgacaaccttttggccttttcaacc

SEQ ID NO: 16002 - DNA, 691 bp, Gossypium hirsutum
  misc_feature (670)..(670): n is a, c, g, or t
  Predicted polypeptide sequence is orthologous to G2559
cattcaaataaacagacaataccacagaaatcaaaaagattttcgttttttaattgtatttggtgatgataacttgggtgtttagaaaaggttaggcaggttgaatatcaagttctcactcaaagcttttgcccgactgagtcactctcagccaacgcactataaaccacttgtacctaccgttgcagatcggctctgtcaatcaaaccagcaaatacaacatcctttcccttctcttttaatctttcttgtcttctctttcacctcgctttgttgtccatcagttgaggattcttgtcaacaaataacgcatggcagaggaagaacccaagaaggttgaaaccgtaaccccctcggagcaaccacctcccgaagcccccaaagacgttgcggaggaaaaatcggtaatcccacctcctacctctgaagaaaaacctgctgagtccgccgcactccaaaaggcggtggaaccgactgaggaaaagagcacggagagtactgtggaccgagatgctgtgcttgctagagttgcgacagagaagcgaatttcactgatcaaagcttgggaagagagtgaaagaagcaaagctgaaaacaaagctcataaaaaactttcctctatcgaggcatgggaaaacagcaagatagctgctctggaagctgagctganaaagattgaggaaaaactaga

SEQ ID NO: 16003 - DNA, 687 bp, Gossypium hirsutum
  Predicted polypeptide sequence is orthologous to G2565
tccacgcgtccgatgaaatcgatagacttgaagacgagtataggaattactgaagcactgcgattgcaggtggaagttcagaagcagctccatgaacaacttgagattcagagaaatttgcagctacgaatcgaagaacaagggaggtatctgcaaatgatgtttgagaaacaaaaaaaggtggaggacgaaaaaggtggggctccctcttctgcctcggatgaccttcttgcaccattaccaggctcaaagcatccaccttgcaacaacggtaaatcagattcagaagctttggagcaagatcactcaagaaccgggattggtccaggaaatgctggcactaacgaggacaaaagctcctcaggtgtaagcacgaagcagaagatgccagaaacagaatcgactgtccatgatgagtccggtttctcagtctcaaaacgtgcaagaacagagaaatagcaggatacttaagactttttaacatctgataaataatcttttgtagacaacatatctctgctcctggagatgatgttgttaatatagataaatctgctgatagaaagcaggagttgttgaaacattacatcatacattcttctttatgtgtatttctctaacatttgaccacatgcaatatattctttcattttgaaagaattataagctaaaaaaaaaaaaaaaaag

SEQ ID NO: 16004 - DNA, 940 bp, Gossypium hirsutum
  Predicted polypeptide sequence is orthologous to G2592, G2713
ttcgtgatgtgagggatagttttgggagcttatctaggcggagttttgatgttagattggtggggcatcatagaggaaaatctcatggtgctttacatgatctgcatgatgagccgcttgtaattcagaacggccgttgggctaatctccctcccgagctgcttactgatgtgatcaagaggttggaagagagtgagagcacatggcctgcacgaaagagtgttgtcgcatgtgcttcagtttgccaatcatggagagtcatctgcaaagacattgttaagagtcctgaattctgcgggaagcttactttcccggtgtctctaaagcagcccgggccacgtgatgggattatccagtgtttcataaaaagggataaatcgaaactgacataccacctctttctgtgtcttagccctgccttactagttgaaaatgggaaattccttctttcggcacaaaggacacgcaggactacttccactgagtatataatttctatgaatgctgacaacatttcaagatcaagcagcagttacatcgggaagctgaggtcaaacttccttggcacgaaattcataatatacgatacccagcctgcctatactgcctcttctcatgttcctccaccaggccgaacgagtcgaagattttactccaagaaagtttcccctaaagtccctacgggcagctataacatagctcagattagttacgaactaaatgttcttgggtacccgtggcccacggaagatgcattgtattatgcattctattccggcctcagctcttggtgtaggtggttcagtccctggccagccagagcttcttcgtcaccctttggaggactcattcagagcatttccttttctaagtctcttgatcattcggtcgagtttagcagctctcggttttcagatgttggtgtgtctcataaagatga

SEQ ID NO: 16005 - DNA, 944 bp, Gossypium hirsutum
  Predicted polypeptide sequence is orthologous to G2592, G2713
tgaaaagagaagaacgaagtaatgatgttcctgcatgcgtgtggatgatctatagcctccattttagcgaaacatagttataatttaagttttgggggttctttgttagtgccaaaaataaatgtcgttccgaagtatggttaacgatgtgagggatgctttggggagcttatctaggcgtagtttggaggtgagatttcctggtcatcataagggaaaatctaatggttcagtgcttgaattgaatgatgagcccatggttatccagaatagccgctgggcgagccttccgccagagctgttgcgtgatgtgatcaagagattggaagcgagtgagagcaactggcctgctcgcaagcatgttgttgcttgtgctgcagtatgcaggtcatggagggaaatgtgcaaagaaattgttagatgtcccgagttctccgggaaaatcacctttccagtttctctgaagcagcctgggtcaagggatggaaccattcaatgcttcattaagagagacaaatctaatttaacttatcaccttttcctttgccttagtcctgctttgcttgttgaaaatgggaagtttcttctttctgcaaaacggacccgtagaactacttgcacagagtatgtaatctctatggatgcagataacatatccagatctagcagcacatacattggaaaactcaggtccaactttcttggtaccaaattcataatttatgacacgcaacctccatacaacaatgctcagctttcaccacctggccgaagccgaaggttctattcgaaaaaagtctccccaaaggttcctaccggtagctacaacattgctcagtttcatatgagctaaatgtcctagtactaggggacctcgtagatgcattgcagtatgtactcaattcctgcctcagctgttgagccaggtggcattgtccctggtc

SEQ ID NO: 16006 - DNA, 968 bp, Gossypium hirsutum
  Predicted polypeptide sequence is orthologous to G2592, G2713
gtagttcagagcagccggtgggctaacctaccccctgagctgcttgtcgatgtgatcaagaggttggaggagagtgagagcacatggcctactcgaaagaatgtcgttgcatgcgcatcagtttgtcggtcgtggagattcatctgcaaagaaattgttaagagtcccgaattctgtgggaagcttacattccccgtgtctctgaaacagcctgggccacgcgatggaaccatccagtgtttcattaaaagggataaatctaaattaacgtatcgcctctttctttgtcttagccctgccctgctagttgagaacgggaaattccttctttctgcaaaaaggacacgtaggactacttctacggagtatatcatttctatgaatgctgataacatttcacgatcaagtagcagttacattggaaaactgaggtcaaacttccttggcacaaagttcataatatatgacacccaacctgcctatacctcgactcatgtccctccaccaggccggacgagtcgaagattttactccaagaaagtttcccctaaagtccctactggcagctacaacatagctcagattacttacgaactaaatgttctcggtactcggggtccacgaaggatgcattgtatgatgcactctatccctgcttcggctcttgacgccagtggtgttgtccctggccagcccgagcttctccgtcatccattagaggactcattcagaagcatttccttctctaaatctcttgaccactctgttgagttcagcagctctcggttttccgaaattggcacatcttatgatgatgaggacgggaaaatgaaacccttgatcctcaaaaacaagcccccaagatggcacgagcagttacagtgttggtgcttgatttccgaggtcgagtaacagttgcttcggttagacttccaattgattgctgccacacaagcagctgctggtgc

SEQ ID NO: 16007 - DNA, 864 bp, Gossypium hirsutum
  Predicted polypeptide sequence is orthologous to G2633
tgagattctccttttgttctttgaaaccccaaacttagcaccaaaacttttagtttagaagtggaatcaaaataagaattcatccggttcttctctttgatgtgttattggtgccaagcagcagttgttggaaatggttgggtgatttaacttattcataataacagtgctattggttaaatacggaggtactttatcagaaaggttttgcagtgctctgttgttgtctgttgactcgtaggattaaataaaagaaacttctgcaatgcaaacgtctcagaaacataaaattacaggcaagtgcattgactggcccgtgcaagagctggagtcctattgttgtcctccaaaccagagcttagagccatgccagtcaggttctgatgatggcagcaatagtgtgcaacattcaattcctaacctggagcgatactgcacccttgattcatcgtccagtgtgcagaactcttcttcgacagccagtttttcacccgatggcagtcctgtttcgcagcaaaactacacttacccattggaccttcatcattccccggaaaatacatgtgcttcaccaataagtggttcttgtgtaatagacaatgaaaatgacttggggctcatgataagacaactggaaactgctatgctaggtatcgattcaggtgatcttgaccttcatgcaatagcagcttctggcagagccactgaagtttccgtagaagcggagaggtggaaatacatgaaagagatgatcgccagaggggacctgaaagaactgctttttgcttgtgccaaagctatagaaagtaatgatatgtatatggctgactgtttgattgcgcattacgtcaaatggtgtcagtt

SEQ ID NO: 16008 - DNA, 963 bp, Gossypium hirsutum
  Predicted polypeptide sequence is orthologous to G2717
cacagcgtcccattgaatcgccgtgaaatctcctgtagcatagcatcgccatggtagaaaaaaataattgaatttaatttcttctttaattctctttttcttttcggtctttttaagaaaaatagcagttcttcgccttccgatctccgattcagtcacccacaaaattatatcataagcttcttgaatttgaaggcttttttcccctttgtgttcctttaaatgggtgctcctaagcagaaatggacacctgaagaagaggcagcgctaaaagctggagtcatcaaacatggtgctggaaaatggcgaacgatactgaaagaccctgaatttagtggcgtcttgtatctgcgttccaatgtagatcttaaggataaatggagaaatatgagtgtgatggccaatggatggggttctcgagacaaagctaggctagctgtgaaaaggacatctagctttcctaaacaggaggagagtgcggtggacctcgctgtagctccaagtgatgaggaaatcgtggatgttaagtctgtcccagtttccagtgctacattacagattccatcttctacaaagagatccatcgtcaggttagataacctcattatggaagcaattacaaccttgaaggagcctggtggttcaaacaagacaaatattgctgcatatatagaggagcaatactgggcacctcctgactttaagaggctcttgtcagcgaagttaaagtatttaacagcttgtggtagactgataaaggtgaaacgcaggtataggattgcacctgctctgtcattttcagacaggaggaggaatcatcccatgctattttcagagggaagggaaagggtttctcctcgatttgatagggatgatttgaaaatcatcacaaaatctcagattgatttagagttagctaggatgaggaagatgacaccacaagaggctgctgcagccgctgct

SEQ ID NO: 16009 - DNA, 899 bp, Gossypium hirsutum
  Predicted polypeptide sequence is orthologous to G2717
ctcgttaaaacaaaaatttccgatgctccgcgcgtgatctcttcctcccttcccacgtttctccgatcaggaatttgttgatgggtgcccctaagcagaaatggacagcagaagaagaagctgccctcaaggcaggagttctcaagcacggaaccggaaaatggcgcaatatactttcagatcccgagtttagttcggtcctgcggtcgcgctcgaatgtggatctcaaggataaatggagaaatataaatgccacggccatatggggatcaagacaaaaagctaagcttgctcttaaaagaaatcagttagccgctaaacacgatgataaccccatggcactaatcaccgtacctccgactgaagaagtcgttgatcctaagccccttgccatttctagtagaacaccaagggtaactggacccaaaaaaccagtttcaaggttggagaatattttattggaggctatcactagtttgagagagccaggtggttccgatagagcttcgattgctttatacatagaggagaaatatgctgcaccgctgaacctcaagaagcttttggctacgaaactaaagctgttggtagcaaatgggacattgacaaaggtaaagcataagtacaggattgcaccacattcaactatttccgaaacaagatctcctctgcttgctttggaaggaaggcagaaggattcttcgaaatcggagaagaaagccatcaacattcttactaaaacccaagttgatgttgagttgtccaaaatgaagaccatgactgccgaagagccgctgcagctgctgcacgagctgttgcagagcagaattcgcaattgcagagccgaaagcagcaagagagcagtgccgcggaagctgaagctgagcagcaaaatttcg

SEQ ID NO: 16010 - DNA, 628 bp, Gossypium hirsutum
  Predicted polypeptide sequence is orthologous to G2717
atgcagatttgttgaaaatgaggagcatgactgcagaagaggctgctgcagctgccgcacaagcagttgcagaggcagaagttgcaatcgcagaggctgaaaaggctgcaagagaggcagatgtggcagaagctgaagcagaagcggcaaaaatttttgctaaagcagcagagaaagcattgaagtctaggatgctatagacctgatggcataaatggaaacctacaattttgtctttagttcattgctggaaaaatgcaagagactccgacatcatgctggcctggcataccaaccgcgatcatgtctataactgtaaatatattaggcttgtaaagaagaaaatgtgagataaatcggtccatcaagcgctactttttgtacgaacatttggtaaaggaggttagaggtgttagtgattctataactttatcatgaagtaaaagggtacagatatagcaaaaagaaatagagaaaggcattcatgatggcacgctttgagatatatgatccgtctctactgaaagtcaacccgaaaacaattgaaccgcaattttgctagtgggtgttcaagctatttagtgttgctgttggctaatggccacctaaaaaaaaaaaaaaaaaaaaa

SEQ ID NO: 16011 - DNA, 908 bp, Gossypium hirsutum
  Predicted polypeptide sequence is orthologous to G2763
cttcttcttttccctcgattccaccctctgagttcatcaaatcgacgcttctgttatcattcaccgaatcatacggtgtagagagagagagagagagagagagagagagaatattagaggattttgatccggtgagatggcgtccatggtaacgaatccagtgacgaacgcaaattctgatcgcaccaaaaggaaaaagaagaaatcaatgatcatggaagacaatcaccagagtcacgccagatggaaatcggaggcgcagcagcaaatctattcctccaagcttcttcaggctttgagccaggtcagtctcaacactccttcctcttcggctcctcgcggtggccgagccgtccgtgaagctgctgatagagctttggccgttgctgctaaagggaggaccaggtggagccgggccattttgacaagccggcttaaactgaaattcagaaagcagaagaggcagaggggagccgccgtggctgccgtcacggggagtagccgctcgaagaaaccgagatttagcgtttccaaactgaaatcgaaaagcttaccggctgttcaaagaaaagtcaaggttcttggacggttggttcccggttgcaggaagcaaccgttgcctattattcttgaagaagcgactgattacatagctgcgcttgaaatgcaggttcgagccatgaccactctcgccgagctgctatctgggctccggtgccgccagctctggctcagctcttccgccccagtcgccgccgcctagtcagtaacacctttttttaatttgcttagttgccaagtcatcctcatcctcatcttccttttttattttttattttattgcctcctcactctctaagtaatgttaaatacatgttttctttgtttttccttttccttcctcacgt

SEQ ID NO: 16012 - DNA, 877 bp, Gossypium hirsutum
  Predicted polypeptide sequence is orthologous to G2766
ttctcctttaacttatataatttcccttcctagttcttccatttctccacgctaccaaagccatgtatccatcatcttcgtctcaaaagcccatgggtcaatccggcctcacccgttacggttctgctcccggctcctttctggccaacgccgttgattccgtcatcggagcggaccctaacctcgtcggccactacttctccgccgctgactcctcctctttaacatcagagtcaacttgtaaagtcagctcatccaacgatccgcgagagcctaaatcagctgctgctgctgctcctgctcctcctcatcctcctccgcatcatccccatggatcttaccctgcaccttcttcttcctctctgctcagacaacgcagctcccccgccggtttccttagtcacctcacatcggaaaacggtttttccgttacaatgggcaacagaaattatagctctcaaggcagtggtaatggtggccatggagtgtcaaggttgaagtcccagttgagtttcactaggcaagattctctttctcagatctctgaagtgagtgagaatcttgtggatggtgttagctctaacagtaaccaccaaaatcctgcacattcgtttgctgctgctggctttggaatggattcatgggataatacaaactccattgtgttttctgccccatcaagcaagagggctaaaaatcttgatggcgatatttataactgtttcaatgccttggaaactcagtttagcttgccccaaacgacactcgagatggccacagttgaaaagctgctacatattcctgaagattccgtgccctgcaaatccgagccaagcgtggttgtgccctcacctcgaagcattgctgaagagagaaa

SEQ ID NO: 16013 - DNA, 1090 bp, Gossypium hirsutum
  Predicted polypeptide sequence is orthologous to G2783
agtacaaaatttttgtaataaaaggaggtttatacagtgcatatgctatttaacaagtgaataacacagccttaagtttatatccccctatagcgaaacaaaggagaaatcaagtagcataagttcataatcctagtaaagagagaacagcagccacgaaagatcgttaatatcagcacttagctatatccgacttgttgctgttgctgtggctgttgataatttccatacccaggataccctccatagtacatgttggggtcttgtggggcagcgccatagccgtaaccatatccttggctgtatccataatatccagcgttccactggtttggatctgcttgggcctgcttgtttgatgtgctacgaccccatgaaagccgaatactttgtccacccaactgagtcccgttcagtattcggagagattcttcagcacaactcctatcagcaaattgaacaaatccacaacgcttgttttgtggaatcttcacatgcaccaactgaccatatgggctgaagacctctctcaaatggtcttcagtcacgttagaatccaaattaccaacaaatatagttgtattatttggatcattctcgttctgagtcccttgcgatgaagctgctggatattgctgtgcagcaccagtcttcttgttagtagccggccctatgcgcataggcctagttgaacaaaaagcaccattcatctcagtcatggcacgattatattcagtttcatcgccaaacctgacaaacccataaccttttgtgcgcccagtgatcctatcaatcacaacctttgcacccttaacagaaggaaagtgtgccctgaaggtctcttgaagcatgtaatctgtaacatcagcagccaagtctccaacaaagattgtgaactcaggggtctcatctcgcctatcgcctgaactaaaggatgcccagttcaacctatagttgctctcaccatttggcataggtgtaccattgtatgtttgtaaaactctctcagcagcagctcttgaaacaaactcaataaatccatagccctccacttgaccggtttgcttgttgcggataacttttacagaag

SEQ ID NO: 16014 - DNA, 840 bp, Gossypium hirsutum
  misc_feature (9)..(9): n is a, c, g, or t
  misc_feature (824)..(824): n is a, c, g, or t
  Predicted polypeptide sequence is orthologous to G2791
ccgcgtttnaccccacagttcgatcccacctcctcccacgatgacttcttagaccagatgctctccactctcccttcttgctcctggtccgacctcaagtcaccttgggacccgcctaaatctgatgaaacgccgccttctaatcatgacaataatgttgggtttcactacgacgagattctagcctccaagcttagacaacatcaaatcaacggcggcggcggagggactactgcagctatgaagatgatgatgcaacagcagatgatgttaccgggaagacccatcgccgccgcaggtggaggagggttgactatgccgttgcataacgatatcgttgatgggtcttcgtttaagtcccccaatcaacagggtggggagggttccgtgcaagctctgtacaacggtttcggtgctggatctttgcatgggactaataatcagtcaccgaaccagcctcagccttttcaccatcctcagggaggcaatatgcagacacaaagctttggagcaacagcagggatagttatgaaccaaagtcaggcaagcggatcgacaacgggaggtgcaccggctcaacccaaacaaagagttagggctagaaggggtcaagctactgatccccacagcatcgctgaaagattacgcagagagagaattgcagagagaatgaaagctcttcaagacctggttcccaatgccaataagacagataaagcttcaatgcttgatgagataatcgactatgtcaaattcctccagctccaagtcaaggttctgagtatgagtagattgggcggtgccgctgctgttgctccccttgntgctgatatgccatct

SEQ ID NO: 16015 - DNA, 904 bp, Gossypium hirsutum
  Predicted polypeptide sequence is orthologous to G2791
atctcctccatcatcaaagcaaaaaaataaccctaattatgcagccttgtagtcgtgaaatgcaagcaatgaactctctcttaaacccgacccaacaaatccctctccaagaccttcaaatcaacggtaacagccaccatcatcaacagatccacgtcccatcatcatcgcagttccagtatcccacaccgacttcaacaacccaccatgacgacagcttcttagaacagatactctcctccaccacgtccttcccgtggtccgacgaaacgggtcctcccaaacccgaggataacaataacgccggcttcaactacgatgagatggttctagcttccaagcttcgacagcatcaaatcaacggcggagctgctggtaaccctttttccgctatgaagatgatgttgatgatgcaacaacaacaacagcaacagcagatgatgttagcgggcagacccacggttgcctcctccgccgccggaggcggaatcaccaccaatcatcagggtggagagggttccatgcaagctttgtataatgtttttggagatggatctttgcatggaactatgcaggcgaaaagctttgtgggggctaattcagcaacagagatgacccaaagtcagggaagtcgtccgacggccggagaagcggtgacggcgccggaaaagcctaaacaaagagttagggcaaggaggggtcaagctactgacccccacagtatcgcggaaagactacgtagagttagaattgcagagagaatgaaagctcttcaagaactggttcccaacgccaacaagacagataaagcttcaatgcttgatgagatcatcgactatgtcaaattcctccagctccaagtgaaggttctgagtatgagcagattgggtggtgctgctgctgt

SEQ ID NO: 16016 - DNA, 550 bp, Gossypium hirsutum
  misc_feature (452)..(452): n is a, c, g, or t
  Predicted polypeptide sequence is orthologous to G2834
tttttttttattaaaaacaaacaattgtcaagattacgactttaacaagaaaaaaaaaagaactgctgttctaacaaggttagagcatttctttaagcaaccaagtacagagggctgccttaccacacaaatttaacacatccctgaatccctactgatgaaggaagaaattagccacaatcaagggctttactcctctccacttttctgactgtaattacaggacctagaaagtagaaatgcaaatgaactctctgagtcatcaaatggtggtcgagggaactcatgaaacccaccaaaattacatgtatcgaagctcaacggtgagaagtaaccaacagcatcatcaatcccccctttaatgtccatactactactttgaacctcactttcactagaaacataagagaggttgaaattcacacttccaaccttattagtggctccatcanatgttccggcgggtgctgctttaatttcatcaaaaggaatggctggagtgtgaccttggaaaagagtgatatgcccaaacagcttatctttccttgaa

SEQ ID NO: 16017 - DNA, 629 bp, Gossypium hirsutum
  Predicted polypeptide sequence is orthologous to G2834
acagggccgtctaacgcgtccgaacaaggatcacaaaaagttccagcctctgaaaaccatcttatgtgtcaaaaaccattacaagagatcccactgtgacaagagctacatcatgcagcaggatgccacaccaagaaattctcagtgattgctgatctcaaaactcatgagaagcattgtggtaaagataaatggctatgttcgtgcggcaccacgttttcgaggaaagataagctgtttggtcacatagctcttttccagggtcacactccagcaattcccctggatgaaactaaaggacccattgccccatctgaccctggagatggcagtgaagcaacaaatgtggtcggaagcatgaatttcttcaactttggtagtgaaaatggggtggatgtcaaatgcagccttgatgatcctgctgcttatttctcaccattgaactttgagacatgtaactttggtgggtttcatgagttccctcgaccggcatccgatgattcggagacttcattggcatttctcctttcaggaacgtgtagttacaataataataatgatgttgagaggtcttgaatattgatggtagactagactagattgtattcttccttggttctagatcgcga

SEQ ID NO: 16018 - DNA, 801 bp, Gossypium hirsutum
  Predicted polypeptide sequence is orthologous to G2846
gggccgcgtcgacagtggtaccaacaacaacagcagtattttgatcgattccactttgggttttggtctttcatcatcggataattggaaccaatccttgctccggagtaataatcaagagtttccaatggattcaacatatgaatgcccttcaacactgttattcgacactgacccacaacaacaatccgtttttaacaacaacaatcagtcaattaactatatgtcttgttcttctttatcatcatcaccttcttggccaaaactagctccaccattgacgacaaagcagcagcaacaaccacctgtaggtactggtaccttacaattctccaacaatacatccttttggaacgcatctgcaactggcaacatattaccttcgttgtatgaagagaaacctaattgtcccaccttgactacaaagactaatatcgaagaagttcggaaaaattcgaattcgaagaaagcaagtaatgaaactccactcaagaggccaagacttgaaaccccatctccattaccaacttttaaggttcgaaaggaaaagctaggggaccgaatcactgccctccagcaattggtttcaccttttggaaagactgatactgcctcagttctacatgaagccattgaatacatcaagttcctccatgatcaagtcaatgttttaagtactccatacatgaaacaagcagcagcttccatacaacagagtactgataagttgaaagatcaccaagaaggtccaaaacaagacctaagaagtcgtgggctatgtttagtgcctgtttcagcaca

SEQ ID NO: 16019 - DNA, 911 bp, Gossypium hirsutum
  Predicted polypeptide sequence is orthologous to G2851
atcatcatcaacaaacagcttcccctttcttccctttccctccaccacagccaccaccaccaccggcggcagcggcgactgctgctactttcttccctcaactcatccctacttccacttcttcttcttcttcatggcatgacaataataaccaagaggggaggactggtgggagaagaacaagcaacagcattacaacaccaagcttcaactggtaataataatattatgaaacaagaaaactatgtgtatggccatgcaaatgaagattaccatcatcatcatcatcattatcaaggatctaaagcaacaactaattggtccatggctactgcttcttcatcaccaaaatcctgtgtaacaacaagtttcaacaacaacatgttggatttttcaagcaacatcaaagctgatactgctacaaggcaacacctaccattaatggatccatcacctgagtgtaatagcagcactgcaagtggtggggcattgaagaaaactagggttcaaccttctgcaactcaatctactttcaaggtgaggaaagaaaaattaggagacagaattacagcacttcaccagcttgtttcaccatttgggaagacggacacagcctctgtgttgttagaagctattgggtacatcagattccttcagagtcaaattgaggctctcagcttaccgtacttgggcagtgatggatcatcaggaaacatgaggcagcagcaacagtctgttcaaggggagagaatttgtatatttcctgaagaccctggtcagctgttgaatgaaaaatgcatgaagaagaggaaaggtagtcctgctgatcttcaggattctaatgaagaaccaaagaaaaacctaaagagtagagggctatgcttggttccaatatcatgtacacttcaagt

SEQ ID NO: 16020 - DNA, 844 bp, Gossypium hirsutum
  Predicted polypeptide sequence is orthologous to G2851
gttttgggagagttgtagtttcataaaagggaaagtgaaaggaaaaccaggaggaaaagagaaagttttctagtgatcatcatcatcttcttcttcttcttcttctttagataagattcataaggccatgaaccgaggtgtgttgcagagctcaccggtgcagcaactgatggccggaaaccctaactggtggaacatcaacaccatgcgcccaccaactcatcatcaccaacaagcggcggcggtggcggcagcaccttctcctttcttgcatcctcctcccactactttcttctctcacacacccacttcttcttcttcgtcttcttcatcttcttcacttcccgttccttcttggcatgataataaccaggagcttcctgagtcatggaatcaacttctcttgggtggattggtaggagaagaagaaaaggggggtgatataggacagtttcaagcgttacaccaagtctcaaatgctaattctgttgtggatgtgaaacaagaaaactctgcaagcagctatgtgtatggacatgcaagtgaagattttcatcatcaccaggcgaataaaccagcttggtttcaccagatatcgtcagctgcttcatcacctaagtccagtgtcacaagtttcagcagtaacatgttggatttttcaggcaacaaagctgaacatgggaggcagccacagccagatcggtcttctgagtgtaacagcactgcaacaggggggccattgaagaagcctagggttcaaccttctgcaacccaatctaccttaaaggtgaggaaggaaaaattaggagacaggattacatcacttcaccagctagtttctcca

SEQ ID NO: 16021 - DNA, 533 bp, Gossypium hirsutum
  misc_feature (9)..(9): n is a, c, g, or t
  Predicted polypeptide sequence is orthologous to G2851
cggcacggnagtaaacataggcagcaacagcctgttcaggggagagaattgatatttcctgaagaccctggtcggctgttgaatgaaaactccatgaagaggaaaggtggtcccgatcggcaggagtgtgatgaagaaccaaagaaggaccttaggagtagagggttgtgtttggttcctgtgtcatgcacacttcaagtcggcagtgacaacggtgctgattactgggctcctgcgctatgagggattccgatagaagaaccctcggaaaggctagcagactttaaacaaaactaaagaaatgtagaagcagtgatgagagctttccatgggaaagaacgatataacatcatgagcagttactctgcaaagttgaaaggctgattgctcacgatgctatataaatgttctttcttttcaacaatttgtagatggtttgtgtgtcaaattaagctctaactggcctgatgattttgaataatttaagcttataattatctatatttttctttcgttaaaaaacaaaaaaaaaa

SEQ ID NO: 16022 - DNA, 634 bp, Gossypium hirsutum
  Predicted polypeptide sequence is orthologous to G2854
aattttttttttttttttttgataaacagttcaaaatagagaactaaaactaaatcgacaaataagaagcataataagttcacaataaacattaaaaagcatcagtccgaaaaactaccatggtgtaatataacactgaatagcaatagactggaaaatcaaatcaaaacaaaactcaatatcagaggataagaaaccaagaaagcgaagctaaaacgatatgggagagagggaaaagatgaaacataacccaaaaaaaagattgtacaggaaacaatgaaaatctacaaccttaaaacatgtttgattggatcacaccaacaactaatgtgctctggatcaatgtcaacgagcttcactccagccacactttttactgctgtggttgttggtacgctcctggctgttggtaattcccatatccaggatagcccccataatacatgctagggtcatggggaggaggtgcatatccatatgcttcatatccttgagcatagccataatatccaccattccactgggcctgatcgggttgagcctgtttgcttgaaggactacgtccccatgaaagtcgaacatttcttcctcctaaaatggtaccatttaaaacatataacgcttgctctgcacc

SEQ ID NO: 16023 - DNA, 790 bp, Gossypium hirsutum
  Predicted polypeptide sequence is orthologous to G2854
gcggccgcgtcgactttttttttagcatcagtccgaacaactaccatggtgtaatataacactgaatagcaatagactggaaaatcaagtcaaaacaaaactcaatataagaggataagaaaccaagaaaagcgaagctaaaaagatatggtagagggaaaagatgaaacataaccaaaaaaaaaattgtacagaaaacaatgaaaatctacaaccttaaaacatgtttgatgggatcagaccaacaacaaatgtgctctggatcaagtcaacgagcttcactccacccacactttttactgctgtggttgttggtaagcccccggctgttggtaattcccatatccaggatagcccccataatacatgctagggtcttggggaggaggtgcatatccatatgcttcatatccttgagcatatccataatatccaccattccactgggcctgatcgggttgagcctgtttgcttgaaggactacgtccccatgaaagtcgaacatttcttcctcctaaaatggtaccatttaaaactgataacgcttgctctgcactagttctattagcatattgaacaaaaccacaattcttgttagcaggaatttttacatgaactacctcaccaagctgactgaatatttgttttaactggtcttcagaaacactaggatccaaaccgccaacaaatattgtggtattatttggatcgttctcgccaggatttccttgagtgttctggtaagtatcttttcctcatcaggcatgaagcatttcttttttctttcacc

SEQ ID NO: 16024 - DNA, 850 bp, Gossypium hirsutum
  Predicted polypeptide sequence is orthologous to G2854
gcggccgcgtctacctggggatcttccaaatctccaccttatctatcaaatatgatgcaacaaccaccaccaggaggcgttgctacgcctccttcaatggcagccgatcagtctcaaacccatcactaccagcaacaacagcaatcgcagacttggatgatgatgtctcaacaacaacagcaggtaggtcagccggttcctccaccttccggctggaatacgcagcctatccctcccccctctcagatgcagcagtaccccgccggttcagcggccgccggctccggcgagattcgatctctctggattggtgatcttcaaccatggatggatgagaattacctcatgaatatcttcgctcaaactggagaggttgtttcagctaaggtgattaggaataagcagacggctctaccggagggatatgggtttatagagtttgtctcgcaagaggcagctgagcgggttttgcagtcatacaatggggtgccaatgccaaattctgagcagaactttagattgaattgggccgctctcggatatggggataagaggcaagaagagggcactgactacaccatctttgttggggatttagctggggatgtttcggattacttgttacaggagacctttaaagctgtttacccatctgttaagggtgccaaagtggttactgataggacaactggacggtctaaaggttatggctttgtgaggtttggtaatgaaactgagcagattcgagccatgacggaaatgaatggaatttattgttcgacaagggcaatgcgaattggaccagctgctaataagaagccattcactggtcagcagtatcagaaaggac

SEQ ID NO: 16025 - DNA, 974 bp, Gossypium hirsutum
  Predicted polypeptide sequence is orthologous to G2854
tcgtaatctcccaaatatctttcctttgtctcatcgaatatgatgcaacaaccagcagctggtggcgtggctccgccaccttccatggcggctgatcagtctcaggctcatcagtaccagcaacaaccgcagtcgcagccttggatgatgatgtctcaacaacagcagggtggtcagccggttcctccacctaccggttggacgccgcaacctgttcctccgcccactcagatgcagcagtactccgccggttctgctgctgctggctccggtgagattcgatctctttggatcggagatcttcagccgtggatggatgagaattacctcatcaatatctttgctcaaactggagaggtggtttcggctaaggtgattaggaataagcaatctgctttaccggaaggatatgggtttatcgaatttgtgtcccgtgtggcagctgagagggttttgcagtcttataacgggctgccaatgccaaacgctgagcagaattttaggttgaattgggcatcacttggatctggggaaaagaggcaagaagagggtcctgagtacacaatctttgttggggatttagcagctgatgtttcggattacatgttacaagagacttttaaggctgtttacccgtctattaagggtgcaaaagtggttactgataggaccacaggacggtcaaaaggttatggatttgtgaggtttggtgatgaatctgaacagattcgtgccatgactgaaatgaatgggatgtattgttcaacaagggcaatgcggattggaccagcttctaataagaagcctgtcgctggtcagccgtatcagaaagctacttaccagaatgctcaaggaaatcctggcgagaatgatccgagtaacactacaatatttgttggtggtttgggaccccagtgtttctgagaccaattaaaacaaatatttagccaacttggcgaggtagttcatgtaaa

SEQ ID NO: 16026 - DNA, 895 bp, Gossypium hirsutum
  Predicted polypeptide sequence is orthologous to G2854
ctcgtctatcgaatatgatgcaacaaccaccagcaggaggtgtagctccgccgccgtccatggcagccgatccgtctcaaacccagcagtaccagaaacaacagcagtcgcagccgtggatgatgatgtctcaacagcagcaggcgggtcagccagttcctccacctgcaggttggaatccgcaacccgtccctccgccctctcagatgcagcagtactccgctggttccgcgaccgtcggatctggcgaaattcggtctctttggatcggtgatcttcaaccgtggattgatgagaattacctcatgagtatcttcgctcaaactggagaggtggtttcagctaaggtgattagaaataagcaaacggcactgccagagggatatgggtttatcgagtttgtatcacgtgccgcagccgagagggttttgcagttgtataatggggtaccaatgccaaattctgagcagaattttaggttgaattgggcggctcttggatatggagaaaagaggcaagaagagggtcccgattacacaatctttgttggggatttagctgcagatgtttctgattacatgttacaagagacttttaaagctgtttacccgtctgttaagagtgccaaagtggttactgataggactacaggccggtctaaaggttacggctttgtgaagtttggtgatgaaactgaacaaattcgtgcaatgactgaaatgaatgggatttattgttcaactagggcaatgcggattggacccgctgctaataagaagcctgtcactgatcagcagtatcagaaagctgcttacccgaatactcaaggaaattctggagagaacgatccgaataataccaccatttttgttggtggtttggatcctagtgtttc

SEQ ID NO: 16027 - DNA, 418 bp, Gossypium hirsutum
  Predicted polypeptide sequence is orthologous to G2893
ttttttttttttttttttatttagagataaaaatgaattagtttatcttcacaacttaacaaacattgaattcctcagttgcagtaataacatttggacaaaaactcgaatgacaacaaaaaatctgaacacaaataaacccagaaaatcaactatgaagaaataacatcagaggttccccttcaatggaagttcccatagttctcccatgctccatatcccatctgcaaaaccatcattaacccaattgttgtccgccatgtggcagtcggcagtcataaaatctccaactgctgatgtggatggcaggttgatggtttccatgccgtagcaactactgttatcaacataatagcaatgctttgcaaccgtgttgtactcattgttatcagtgatgccgaatgaacttgtttggtac

SEQ ID NO: 16028 - DNA, 861 bp, Gossypium hirsutum
  misc_feature (837)..(837): n is a, c, g, or t
  Predicted polypeptide sequence is orthologous to G2907
gcggccgcgtctacctttttcctgttgtgagcattgccttctgagcaactagacatagtaaaacattgctccttaatctcttctaaaacattaaaggtctttggcatcacaaaatgtaattgtagattttcatatacatttcttaactctgaacataattgaatttaatatttgtctcattctcaagtgttttctgtaagtttcttaatagttcccatgaacagccattttctagtttttcttttttactttctgaaattttgtcagggaaataggacaaattttaaccgtctcaaagagactgaaggagctattccatattcccaagaagctgtaggaattgtacccaattctgaggtggaaagttctatgtcttccaattttcttcccaataatagtcagattccttcacaaactatggatacagcaagcatgaacagtgtgcatgtgcaggcatcagaatatgaagatgctgaatcagtgtctaatcatcaagcaagttcacagttccattcttttcttgattcacatcagcctgttgcagggagggctgataccagattctatgatccatatgttcatgtatcacattcaaataattgttatgggaagccatctataactgcttttcaacttactcaaactgacaaggatagagagtataatgttgctggaataacgtatgagccccagaagaaccttgatttcacatcatgggaggatgtgttgggaaactgtgatcgtggggttgaatctgcacagtatcagccaccatttaccttgaaacaaaatgatactgtggggctgctatttgacaacagctttcttaaaaagcangcgtttgaggatcaatcacatgct

SEQ ID NO: 16029 - DNA, 857 bp, Gossypium hirsutum
  Predicted polypeptide sequence is orthologous to G2964
tttggttctcttcctcttcctcttcctcttcctcttcctcttcctcttcttcacccaaaaacccccgcccgaagctaggtgaaagaagttctctaatggatactcgtaaaaggggaagacgtgaagctgggttcaatgctaatggcggcatcaagaaatctaaaccagaattggaatctttatcaactggtgtaggaagcaaatcgaagccttgcaccaagtttttcagtactgctggttgtcaatttggtgagagctgccatttcctgcactatgttcctggaggttacaatgcagtgtcccagatgatgaaccttgcaccagctgttcaaccagcttctagaaacgtggcagcgacagctgcaatacctcatggatctgcctctgcggtcaaaactcggttatgcaacaaatttagtagtcccgaaggttgtaagtttggtgataaatgtcattttgcacatggagagtgggaacttggcacacctattgctccatctcttgatgatccccgttccatggcacctcttcctggccgcatgggcagtcggatggaaccaccacccccatcaggtcctgctgctacatttggtgcttcagcaactgcgaaaattagtgtggatgcttcccttgcaggagccattattgggaaaggtggtgtgcactccaagcagatatgtcgtcaaacaggtgcaaatctatctattcgggaacatgagtcagatccatcacttatgaacatcgagctcgaaggatcatttgagcaaattaaagaagccagtgcaatggttagagaactaatcagcagcctgggtccagtaccgggtccggccaaaacagctggtgcacatggtggt

SEQ ID NO: 16030 - DNA, 944 bp, Gossypium hirsutum
  Predicted polypeptide sequence is orthologous to G2964
gggttactcttcttcttccttctctctctgggcttttacattcctctttctttggtttttagggttcctgaaactcttgcagtcatttgatttttttgttggtatctttttcctttggatatggatctgtgatttttcattaaaagcaaagttctcaaatggatgctcgtaaaagaggaagacgtgaagctgggtttaatgctaatggcggcatcaagaaatctaagccagaaatggaatctttatcaactggtgtaggaagcaaatcgaagccttgcaccaaatttttcagtactgctggttgtcaatttggtgagagctgccatttcctgcactatgttcctggaggttacaatgcggtggcccagatgatgaaccttgcaccagctgttccaccggcttctagaaatgtgacagcaacagctgcagtcccgcatggatctggctcccaagtcaaaactcgcttatgcaacaaatttagtggccctgaaggttgtaagtatggtgacaaatgtcattttgcacatggagagtgggaacttggcaagcctattgctccatctcaagatgatccccgttccatggcacctcttcctggtcgtatgggcagtcggatggaaccaccacccccatcaggtcctgctgctacatttggtgcttcagcaactgcaaaaattagtgtggatgcttcccttgcaggagccatcatagggaaaggtggtgtgcactcgaaacagatatgtcgtcaaacaggagcaaagctatctattcgggagcatgagtcagatccatcacttaggaacatcgagcttgaaggatcatttgagcaaattaaagaagcgagtgcaatggttagagaactaatcagcagcctagtccggttccaggtcctgccaaaacacctggtgcgcatggtggtcaagggcatccaggaagcaactaca

SEQ ID NO: 16031 - DNA, 878 bp, Gossypium hirsutum
  Predicted polypeptide sequence is orthologous to G2964
tatttccacccttttcctttctcctccctccgcgctttcccttcttctccgaaccctagctttccattttctctcacttttgtttctttctcttggatttcgttgctcgcccaatggagtttggtggtggacgcaagagagtgaggcccgaggctgccttgaacggcaatggcggcttcaagaaatccaagcaagaaatggagtcctttccaactggtataggaagcaaatcaaagccatgcacaaagtttttcagcacttctgggtgccaatttggtgagagctgccacttcttgcattatgttccgggtggcatcaaagcagtgtctcagatgctcggtaacaacccagctcttcctgccgctgccagaaattcagtagtcccaccatcctttcctgatggctcatctcctccagctgtaaagacccgcctgtgcagcaaattcagcacccctgaaggttgcaagtttggtgataaatgccattttgctcatggcgaatgggagcttggaaagcggactggtcctacttacgaagaccctcgttccatgggaccaatgcctgggaggatggctggcagattggagcctccctcaccaggttttggtgctgcagccagcttcggagcatctgccactgccaagatcagcattgatgcatctcttgcaggagctattattgggaaaaatggtgtgaactcgaagcatatttgtagggttacaggagccaaactttctataagggagaatgaatcggatcctagttcaaggaacattgagctggagggaacatttgatcagatcaagcaagccagtgcaatggttcacgagctgattataaatgttggttcggcctctggaagtagcatgaagaacacc

SEQ ID NO: 16032 - DNA, 846 bp, Gossypium hirsutum
  Predicted polypeptide sequence is orthologous to G2969
ggcctgaatacttgaaccacaaagctatctcacctttgttatcaagctctctgagtgcgcgtctatcaatggcgaaaaccaatattgggtcattcttcaataagttcctttctcttttcatccttcttctccaccttggttgcttcgttttcaccgccgctaaagacaaccataaagcaaccaagaaacgcaaatcctcacctctttctcctaactctcacaaacaccgcaaagctctttcctccacatggacttttctcaaacgcatttttttcttctaaagccaactgcataaacaccatccaggccgcacaccctccaacatcagcaaccacacccgcgttaacctttgcaagaaactcccaacattcccttgtctccatgtccatgatcaatccacctgaaactcacctatcagacagccctcccccactttctcaaatacaatccgggtcttgtccagaatccgatatctcatccgactacccgtttttccctctacgtaacgatatcttcccatgcacagcttgcggcgagatttttcagtaaaccccatttgctcgaacaacaccaagcaaccaaacacgccgtatccgaactcgttgatggcgattcaggtaacaacatagttcggatcatactcaaaaccggttggaccgacaaagttaagagccctgaaatccaccgtattttgaagatccataacagcccaaaaattctaaccaagttcgaagaatacagagaggttgtcaaagcgaaagccgctagaaacggtgcgatggggaggcgagacgagaggtgcatagctgatgggaacgagctgttgagatttaattgctcaacttt

SEQ ID NO: 16033 - DNA, 859 bp, Gossypium hirsutum
  Predicted polypeptide sequence is orthologous to G2981, G2982
ggtaagtggtagtaaccatattcaaaaccataaccaccatgaaaatggggagaaaaacccaactttgggaggagcttctaggtcgtggggcacgaccgtttccggtcaatccgtttcgactagtggtagtgttggctctccctcgagccggagcgagcaagctatggctacaccagctagtgagaatactttcttaagattgaaccatctcgatattcacggagatgatgctggatctcaaggtgccgttggtaaaaagaagaagagaggtcaacgtgcagttgcaggtgataagagtggcagagggctccgccaatttagcatgaaagtttgtgaaaaggtggaaagcaagggaagaaccacatacaatgaggtggcagatgaacttgtagctgaatttgctgatcctggcaatagtgtagcatcaccagatcagcaacagtatgacgagaaaaacatccgccgaagggtttatgatgctctgaatgttctaatggcaatggatattatatctaaggataaaaaagaaatacagtggaagggacttcctcgtactagtctgagtgatattgaagatttaaagactgaacggcttgggctgagaaataggattgataaaaaggctgcctatttgcatgaattggaggaacagtttgtaggtcttcagaatttgatacaacgaaatgagcaactatacagctcaggcaatgcttccggtgggggagtggctttacctttcatcctggtgcagacacgccctcatgcaactgttgaggtagaaatatcggaagatatgcagctggtgcattttgactttaatagcactccctttgagctccacgatgacaattatgttttg

SEQ ID NO: 16034 - DNA, 958 bp, Gossypium hirsutum
  Predicted polypeptide sequence is orthologous to G2989, G2990
ccttcatctcccccccatttaacaacccaagagagaagagcccatttttccccccgtttctctatcccttttcctttttcattaccaagcttcgtaatttcttgcatattatcaaatatttctcataaaacccatctttaaaacccttttaaaattcatttttagcctttttctttaatttttacctttttttttgcttggtgttaactctagatgttaaagccatggatatagctcttgcaagcaccgcaccaaaatcgccagaggctgagcccgagcctgagccagtgagtgaaacaccaactcggatccaacccaccaagcctgtatctttcaccaacggtgttctcaagcgtcacaagcctcaccaccaccaccaccactaccaagcgccacccatcgtcataacctacaaagaatgtctgaagaaccatgcagccagcttaggcggccatgctttagacggttgcggtgaattcatgccgtcgccaacagccaccccaactgacccaacttccctcaaatgtgctgcttgtgggtgccaccgcaacttccaccgccgcgaaccggatgacccaccacccacaacagctaccccaacaatagaataccagcctcaccaccgccaccatccgccaccaccagcaacggcaggtcaaccaaatcgtagtcctaactcagcttccccacctccgatctcatcatcttactacccttcagctccccacatgcttttagctctttcaggaggtcttacaagctcccatttaccagctggtgggctgacaccaaacactgctaatcttggttccaactcaaagaaaagattcagaactaagttcactcagtaccagaaggataagatgctggagtttgccgagaaaattgggtggaaaatccagaaaagagatgagagatattcaagaattctgccgtgaagttggggttgatagagggg

SEQ ID NO: 16035 - DNA, 948 bp, Gossypium hirsutum
  Predicted polypeptide sequence is orthologous to G2989, G2990
cctagatgttagagccatggaaatagcccctacaagcacccctccactaagcaccacaacacccaaatcacccgacccagagaccgaaacaccagttcggatccatcctgccaagcccaaatcttttactaacggtgttctcaagcgccaccaacctcaccaccactacctccaccatgcgccgcccatagtagtgagctacaaggaatgcctcaagaaccatgcagccactttgggtggacatgctttagacggctgtggtgaattcatgccttccccatcagccaccccatccgacccaacttccctcaagtgtgcagcttgtggttgccaccgcaacttccaccgccgagaatcagatgacccaccacccacaacaacagccaccgctactatagaatatcagcctcaccaccgtcaccatccaccgcctccagcaagtcaagcaccacatcgtagtccaaactcagcttccccaccaccgatctcatcatcttactacccttcagctcctcacatgcttgtagccctttcaggtggtttagctggtgcattagacaacaaccaccatcaaaataactctcatttacaaggcttaggaacccttaccccaaacaccacaaatctgggttcccactcaaagaaaagattcagaacaaagttcactcagtttcagaaagataagatgttggaattcgctgagaaagttgggtggaagattcagaaaagagatgaacaagctatccaagagttttgcagtgaagttggggttgatagaggggttttaaaagtttggatgcataacaataagaacacttttgggaagaaagatcaagccattaatgaaggagaaactgggaataacaacaatactgagaatggactcagccatgaagaccaccatcaccacacaacaacaatggtcagaatctcaaccatcactttgaa

SEQ ID NO: 16036 - DNA, 794 bp, Gossypium hirsutum
  Predicted polypeptide sequence is orthologous to G2997
gtgtttgttcgcttactttgcttcaacaaaatggaaagcacatgaaaggctttcgagtaagacacccttttgcagcctcgcctttgtgggtttccttctgcatcaacaaaaacaagggcagggggggaaagggaaaaagaaagtggccactgggcagtgaaatatatatttttttatagaaaaagaaatggattttgaggaacatgatgaccaagacgaagaaatgggtatggctgttccagcaggatacgactcactcggcaactcgtcagctccacggtctaaaataggacccgcagcaagtggcggtgaaggtgcggcggcttctgcaccaccgagaaaagtggggtcaggtataaggtaccgcgagtgtcaaaaaaaccatgccgtgagtatcggaggccacgcgttggatggctgtggggagttcatggcggcaggtgatgaagggacacttgacgccttgaaatgcgctgcttgtaactgccacaggaactttcaccgtaaagaaactgacggtgaaggtagtagtatctacaaccctcaccatcatcatcaccactaccagcaacacccccaattctcgccctactatagggcgccgccaccggccgggtacctccacctgactccacagcagaggcctttggccttgccagcagcgtcgggaggtggtattgccggcggttacagcagagaagacgaagatgtttcgaatcctagtagcagtgccggtggaggtggcggcagtgggggattaaagaagaggtttagaaccaaatttacaccggaac

SEQ ID NO: 16037 - DNA, 868 bp, Gossypium hirsutum
  Predicted polypeptide sequence is orthologous to G2997
gtgaagagttggaatgcattttcaagtccgctctgcagactgtagccaataatggccaaaccccaaacccaatccctgctatcatcactgtagccacactcttgttcgcttcacgggaggggaaaatggagtttgaggatcaagaagaacaggaagaagaaatgggtttgacaccgagttatgactcgctgggaaactcgtctagactcaaaatgtcaggtgttgaacctggttcagtaactccaacgggtcagcagcagcagcagcagcagaggaagcctaggtatagggagtgtttgaagaaccatgcggtggggatcggcggtcacgctctcgacggttgcggtgagttcatgccggctggaactgaaggcaccctcgacgctctcaaatgcgcggcttgtaactgccaccgtaacttccaccgcaaggaatctgagcttggctccccaaactccgtccacaccacggacctctacttccatcaccaccaccaccaccagccaccgcaatttgcgccttactttagagcaccaacagggtacctccacgttgccggacaacaaaggccattagctttaccatcaacctcaggaggaggaggacacagcagagaagatcaagaggatgcttcgaatcaaggaagctcaaggaagagatttagaacaaagtttacgcaggaacaaaaggagaagatgctgagtttagctgagagactagggtggcggattcagaaacatgatgaagagattgttcaacagttctgcaacgaaactggggtcaaaaggatgttttgaaagtttggatgcataaaacaagcacactcttggtaagaaccctagaacagattatgaggaactttagatgt

SEQ ID NO: 16038 - DNA, 986 bp, Gossypium hirsutum
  Predicted polypeptide sequence is orthologous to G2998, G2999
tggattttggctggataatgctaaatatcgggaggaatataggggaaagggaaaacaataagatatctaacctagataagcttcttgcatcatcatcatcatcaccgtcatctcttttgataacgtttcaaagttttccgagttaggtgaatagttgaatagtgagcttcattttaggctctttattttgtgtttagtcgataattagttgttaaactatggaagttagaggtgaagaacatgatattaaaacgccagtgcgagatggggatcataatggtgctgcggttctcacttgcactcaaaccctagaccaagttcatcgtccccaaaggcaacagtcacttggccatgttggaagatctccgaacccggatcgaatcgccggcgccagtgttgcacccatttcagtcagttctaacacgaagccattggcgggtgtcgttaggtatcgagagtgtctgaagaaccacgctgccagcatcggcggaaacgtttacgatgggtgcggtgagttcatgcctagtggagaagaaggaacactggaagcgttgaaatgtgcagcctgtgactgccaccgcaacttccaccgcaaagaggttgatggagagacccaacaattcgggggtaggagaagcttgatgcttaaccctcttcagttgcctccaccattgccctctccaaccatgctgcaccaccaccaccatcaccatcaaaagtatacaagtccacccagtgcaatggttacaccaatgaatgtagcgtttgttggcggtggcaccgagtcttcaagcgaggatcttaacatgtatcagtctaatccggagggaatggcggcagcagcacccccatatgttttgtcaaagaagagatttagaacgaaatttacgcaggaacagaaggataagatgttggaattagcggagaaattgggggtggagaatcaataaacaagatgaagatgaagtcgaaaagttttgcgctga

SEQ ID NO: 16039 - DNA, 931 bp, Gossypium hirsutum
  Predicted polypeptide sequence is orthologous to G2998, G2999
accaacctgtctcttgttgggatatatatctgtagttggcttattgggagcacaaacccaaacactgtatccttaaccctaaactccaacccccaaccccaaattcctttccctcgtttctctttgcttctcccttgctaattacagatgtttacaccctgcttagatggtgtggtaaaggcgtaaaagcggtggcctgactctgccgtttcctcatctctttcttaaaactctcgttgaaatttggggtatgggtcgagggattttggcaccataatgctgaatacatgaatatctgaggaggaggaggaggaagagataagggaaaccaaccatatatcctagataagctacgtacttgcatcttctcttttatgaaatgcttcaagttgcacacaaaagcacgggaaaacaaatctattatgagttgaactttgagcttgtttagcttggataaaatatcataaaaaagtttgcttctcttttttgtttttcaaccaactactccttaaattatggaagtgagaggccaagaacatgatattaaaacgccagggtcttcagcctttggtcttcactcgcctggagtagagagaagaaaagatgggaaccataatggtacggccgttctcacgtgcactcaaaccctagatcatgttcatcatctccagaggcagcaatcactcggtcaagggagatccccacatccggatcgagtcgctgccgccactggtgctgcagctgttgcacccatttcagtagttcaaacgcaaagccgtccagcttcgtcagataccgagagtgtctcaagaaccatgccgccagcatcggcagaatgtgtacgatggctgcggcgagttcatgcctagtggtgagatgacactcgagcttgaatgtgctgctgtgactgtcatcgcacttcatcgcagag

SEQ ID NO: 16040 - DNA, 514 bp, Gossypium hirsutum
  Predicted polypeptide sequence is orthologous to G2999
ccatctcttaatttgcctggtttcggtgtgaagtcccagggaagctcagccatgccttccattgatgaactggggttgagccatggtcatggtaatgcaagcgtcggtggcttacaaagtcatggggttggcttgaacgatgggaaccaagagcatttgaagacctttagatgggagttatggtaatactgatcataattcacacagagttaacagctgcaaaatgaactactcagcgtcctcatcagctttccaccatgacaagggattggacaccgtttcttcaagaaccgaaggtacccttgattcatggatttgtcctgcagaatagaaatcattgatcactactaaacttaattaatgtgcagaatattgtcagcactagaagggttatttttctcttctttttctcttttgttcatttcagaaataattaattcacattatatatatgcttaattccgtcagtatacttatattatcctcctctgtcgggattaacacacttgtaaaa

SEQ ID NO: 16041 - DNA, 934 bp, Gossypium hirsutum
  Predicted polypeptide sequence is orthologous to G3055
agattatcgtgtttggaacaaccaagaaacctccaccgacacccttctgtccaattccgaccaggcaccgaacaagaaaccaagaaattcccaggatttaaacactaggtccagagccataggcaagatgttcttcaagaccaagctttgttgcaagttcaaagccgggacttgtccttacatttcgaattgcaacttcgctcacagcacagaagagctccgccatccacctcctaactggcaagaaatcgtggccgcacacgaagaagagaaagggatcctgtcggagccgagggaagaatttcaaatcccatctttagggtctaccagtttctcaggagaaacacagaggtcatataaaggaaggcattgcaagaagttctattcggaggaagggtgtccttacggtgataattgcacctttttgcacgacgagcagtccaagaatagagagagtgtagctataagtttgggtcccggagggtacggtggtggtggcgccggcggaggaggaaatggtagtggtggtgggaatggatcaaatgcaaagccgtctaattggaagacaaggatttgtaataagtgggaacttactggttattgcccttttggaaataaatgccattttgctcatggagctgcagaactacaccgatacagagggggccttggtgatgcagaaactaaggatactaatgctaccctgcccgactcgaagcaaggcggaggaatgcctttgagaactccttcagaccccgcggcggcgtcagttccccaacttccggtttcagacgtttaccactcacaaaggacatcgattgtactccaaaggccggggcaaagaactcttcagaaatggaaaggtccagataaaatcagtctaatatatggtgactggatcgatgatattcaataaactcatttctttcgagta

SEQ ID NO: 16042 - DNA, 548 bp, Gossypium hirsutum
  misc_feature (47)..(47): n is a, c, g, or t
  Predicted polypeptide sequence is orthologous to G3067
ccacgcgtccgatggattctctgccaagaaagagctcaaggaaggancttggtgtttttacaacttccacaagtggacgagctttcgagtccattcaaattctcgaagacgatccatctataaggaaagctttaatagtttgcagggtaatagctggacgagttcatagacctttggagaatatacaagaaatggcaggccaaaccgggtttgattcgttggccgggaaagtcggtctatattcgaacatcgaagaactttatctgctcaatcctagagctctacttccttgttttgtggtaatctgcaaaccttagaagacacaagttgtgactttatgaaagttatgtgaatccctttttccttggtagagtttttcttttttggaaagaattctcattcttcttgcaatattcttgttaattgctgatatgttctggtttttcatgcaattatattgcttcttttgtgtttaggaactgtattgtagatgaaagatgtgtggaaaaatttatatttcatcaaccatgattggatatttcaagctt

SEQ ID NO: 16043 - DNA, 956 bp, Gossypium hirsutum
  Predicted polypeptide sequence is orthologous to G3074
aaaaggaaaaagctatattcggatctgcgataggtggaaggtggtgttttttgttagatttttttttcatgtttgaaaggattaggtcaacaatgatttccttctgaaggttttttttttctttgaaagggaaaagatcttgttttggtttactttttttttagtattttaataatttaatgatccaaatctgccaaccaaaccatgaggaagaagcttgatacccgtttcccagctgctcgcattaaaaagattatgcaagccgatgaagatgttgggaagattgcgttagcagtgcctgttttagtttctaaagcattggaattgtttctacaagacctttgtgatcgtacatataagattacccttcagagaggagcaaagaccatgaattcattacatttaaagcattgtgtacagagctataatgtatttgattttctgagggaaattgttagccgggttcctgattatggtcatggtcatggtcatggtcattccgatgctgttgctgctgctgctgatgacgatcgaagtatttcaaggagaaggaaagccgctggagatgaagtccatgacagtgatgaagaatcaaagaggagcagaatatgacaaagaggtatctggtgaacttcaatttattatgccaaagccaaactatgttacttggactcgggtatgagtgtcggatacggacatatatctgacacggcatgatgtgggtcatgtagggaccattggtagagggagaggccggggacgaggtaggggacgtggaaagaggaggtcgaaatgtggaaagagatgctcatcgtgaaatagaaccagaaccctgtgcaactcttcagcaaaacagcaaaagtcatccaacccctggaatgctggtagatgatgggttctgagtccaaggaaccgataaaagagaacacaattgctgaagatgccaccaagctgtt

SEQ ID NO: 16044 - DNA, 861 bp, Gossypium hirsutum
  Predicted polypeptide sequence is orthologous to G3074
cccaaatcatgaggaagaagctcgatacccgtttcccagctgctcgcattaaaaagattatgcaagcagatgaagatgtcgggaagattgcattagcggtgcccgttttagtttcaaaagcattggaattgtttctacaagacctttgtgatcatacgtatgagattactcttcagaggggagcaaagaccatgaattcattgcatttaaagcattgtgtacagagctacaacgtattcgattttctgagggacattgttagtcgggttcctgactatggtcatggccattctgatgctactgctgctgctgctggtactgatgatcgaactatttcgcggagaaggaaagctactggagatgaggtcaatgacagtgatgaagaatcaaagagaagcagaatgcatgatatgggtcatgcaggcaccagtggcagagggagaggccggggacgaggcaggggtcgtggaagaggagctcgaaatgtggaaagagatgctcatcgtgaaatagaaccagaaccctgctcaactcttcagcaaaacaacaaaagtcattcaacctcaggaatggtgatagatgatggttccgagttgaaggaaccggtgaaagagaacacagctgctgaagatgccaatcaagctgttcggaattttgatctgaatgccgaggtagatgagaatgtggatacaaaagcctcagcaactgctgctaaagttgctgcacctgcacccccagtcggtgttgctagtggcgctgctgcaccagcagcgccagctgcagcagctcagccttctacagcagagcctacacagaggccaacatgaagaataccaggctggtctctttcggatatggaca

SEQ ID NO: 16045 - DNA, 810 bp, Gossypium hirsutum
  Predicted polypeptide sequence is orthologous to G3091
gcggccgcctcgacattttctctctctaaaatctcacttcaaaaaaagtctgttttttttaactaagttcaaactggctatcgaaaatcaagaatccactgttcgtgaaatcaagcccaagaacagaagaatcatgggaggtggtggacctgatgaagaagacaacaataacgacaagtggccgccatggttgaaacctttattgaaagaacagttctttgttcaatgcaagcttcatattgattctcataagagtgaatgcaatatgtattgcttggattgtatgaatggttctctttgttctttttgccttgcttatcacagggatcataattacattcagataaggagatcttcgtaccatgatgtaataagggtatctgagatacaaaaatatttggacatatctggtgttcaaacttatgtaataaacagtgctaaggttgtcttcctcaatgaaaggcctcaaccaaggcctggtaaaggtgttatcaatacttgtgaagtctgtgatcgtagccttgttgataactttcggttttgctcccttggttgcaagattgttgggacgtcaaaggattttcaaaagaagaaaaggcaactagcgatggtatcgtcggactctgaggattcatacagtagtagtagccatgggaagccaaggaagaatgacgacaacagcaacaaagttcgtagttttagtccatcgacgccacctccgacttcggttaattaccgaaatgctaaacgtaggaaagggattccccagcgagctccaatggcaggactaatcatacaatattaaagctc

SEQ ID NO: 16046 - DNA, 824 bp, Gossypium hirsutum
  Predicted polypeptide sequence is orthologous to G3091
gcggccgcgtcgactttagattagaactcaaaattcatatataggcaaaagatataaacactcccttggaaaaggagtacaatacatgatattttccctgtctttcacattgctcttagtcttcttgccctaaaaccagaaagaccctatttacaatttagcatttgccaaaaacttatgtctatagtcactcacttagaaaagctggctcattatcattattactatttccacttctatattttgcttctcctatatatatatcatataatatacataatagtagagagaggtatgtatggcgtaacactaatactaacactaacagggtaaatataaaaggatataagccactatcttttatggcatttctttggcttaatattctatgattaatcctcccattggtgctctgtggggaatcccttttcttcgtttggcagttcgagttggaggtggtgttgatggtctaaagctctgcactttgttgttaatcttctcatggcaactgctactgtatgaatcctcagagtctaatgctgccatgttcatacctggctgccttttcttcttgtggaaattctttgatgttccaacaatcttgcagccaagagagcagaaacggaaggaatcgacaaggctgcgatcacagacctcacaagtgttggtaacaccttttcctggcctgggttgtggcctttcattaagaaaaacgatcttagcactgttgattatataagtttggactccagatatgtctaggtatttttgtatctcagatactcttatcacatcatggtatgaagacctccttatctggatat

SEQ ID NO: 16047 - DNA, 744 bp, Gossypium hirsutum
  Predicted polypeptide sequence is orthologous to G3091
gcggccgcgtcgacgtgaaatcaagcccaagaacagaagaatcatgggagctggtgggcctgattaagaagacaacaggtggcctccatggctgaaacctttgttaagagagcatttctttgttcaatgcaagcttcatgctgattctcacaagagcgaatgcaatatgtactgcttagattgcatgaacggcgctctctgttctttctgcttagcttatcacaaggatcatcgttacattcagattaggaggtcttcataccatgatgtgataagggtatctgagatacagaaatacctggacatatctggaatccagacttatgttatcaacagtgctaaggttgttttcatcaatgagaggcctcagccaaggcctggaaaaggtgtcaccaatacctgtgaggtctgtgaccgtatccttgtcgactcatttcgcttctgctctcttggttgcaagattgttggcacatccaagaatttccagaagaagaagagacacttggccatggcctcagattctgaggattcatacagcagcagcagtagccatggaaagcttatgaacaactgcaacaaaatgcgaagctttagtccttcgacaccgcctccaacttcagtgaattcccgaactgcgaaacgaagaaaagggattccccatcgatccccaatgggaggtctaatcatagaatattaaccatagcccatatacaaaagatatatatttaccctactatgttaccc

SEQ ID NO: 16048 - DNA, 889 bp, Gossypium hirsutum
  Predicted polypeptide sequence is orthologous to G3091
atgacagattaggaggtcctcataccatgatgtgataagggtatctgagatacagaaatacctggatatatctggtgttcaaacctatgttattaacagcgctaaggttgtgttcatcaatgagaggcctcagccaaggcctggaaaaggtgtcaccaacacctgtgaggtctgtgaccgtagcctggtcgactccttccgcttctgctctcttggttgcaagattgtgggtacatcaaaggatttccagaagaagaagagacatgtggccgccatggcatcagactctgaagattcatacagcagcagtggccatggaaagctcagtaacaaattgcagagctttcgtccttcaacgccccctccaacttcggttaattatcgaactgcaaaacgaagaaaggggattccccatagagccccaatgggaggactaatcatacaatattaagacataaccatacccatagagctcatcctttttgtcctggagttgaaatatatttatcctaatagtatttgccccacagatacacacaatcatggtgccacaatgccccctaatgtttagagccgccacctctctctagtatcgtgtatataaacatcagcagtagcagcagagaaggatggcaaaaataagggccccaaatgagctttgcttttagtgttttacaagttgaaaattaggttgagagcgttaattttaatgtttagagttttgggatcttatacaataggttggttgatggggaaatcagatgtgtaaatacggggaaagggtagtgcaaaaagaaaggcacttactgtggtgctgaggtatgtttatgttacatatattaatattcggggtggtgttatggaattgaaatcatagtaaggttttagt

SEQ ID NO: 16049 - DNA, 833 bp, Gossypium hirsutum
  Predicted polypeptide sequence is orthologous to G3967
gcggccgcgtcgaccaaattttgttcatcttataaattctagtctaaaattataaaaacagatggcctgcttttctttgtggctgctgatttgaacaccgcatgttttataaaaggtgatgtcagttcataattaagataataaaatccaggactaccatttgctataaaacacttccgtataatcagatgaaatctcatgcagatggtgaccaaaccagcagccataaatagcctcattgtctacattttttgttttttaacttcatttgttccatctgtttggtcactttcatggccttgtgttcttgtcaggcggatagggaattgcagccttggattgccaaagatgacgaccaaggtcagaagatgtggagaatcaaccagcgaattgtaaaattgatagtcgagctgatgagaaatcatgatagcgcagaatcattggtaattgtggcaagtgcttctgatctacttctacgtgccacagatgggatgcttgttgatggggaagcttgtactttaccacaactggagctgctggaagcaacagctagagcagttcagccagtactcgagtggggagaatcaggactggcagtagcagatggactttcaaacctgttaaagtgtcgtctaccagctacgactcgatgcctttctcatccaagtgcacatgttcgagctctcagcacatcagtccttcgcaatattttgcatataggttcaatcaattcaaaatctaaggtggaaataaatggtatctgtggtccctcttaccagttcttcaatataggtgccatcaactggcaaactgatatcgaaaagtgcttaaca

SEQ ID NO: 16050 - DNA, 894 bp, Gossypium hirsutum
  Predicted polypeptide sequence is orthologous to G3967
acgggaaaaagtgtagaaagtttcccattagatgcctcggatttggccaattttcttacaaaggataggcacttaggattccattgcagtgcacaaattcttctaagatccgtgcttgtggagaagcaagagttatgtttctctgttgtttcactattgtggcacaaactgatagcagcccctgaaacacaacccagtgccgaaagcacttctgcccaacagggatggagacaggtggttgatgcattgtgcaatgtcgtatcagcatctccggcaaaagcagcaactgcagttgttcttcaggtccaaattttgttcttcttgagaacatcagctttctttatcgctgctgacttgaactccctatgttttttgtaaaagtctacaatgattcataatctggatggtgtccaaatcagcagccataaattgccttattgtctagctgttttactttagtttctctatttgtttggtcacttttatggccttgttttcttgtcaggcggatagggaattgcagccatggattgccaaaaatgatgatcaaggtcagaagatgtggagaatcaaccagcggattgtaaagttgatagtggaactaatgagaaatcatgatatcccggaatcattggtaattgtagcaagtgcctctgatttgcttctacgtgccactgatggaatgctcgtagatggggaagcttgcactttaccgcaactcgagctgctggaagcacagctagagcagttcagcagtactagagtgggggaatcgggactggctgtcgtggatggactttcaacctgttaaagtgtcgtctgcactacaactcgatgtcttctcatcaagtgcacacgttcgtgctctcagcatatcggtacttcgcatatctg

SEQ ID NO: 16051 - DNA, 843 bp, Gossypium raimondii
  Predicted polypeptide sequence is orthologous to G28, G22, G1006
gataaaaaaacatccccaaacacaaaatttgaacattttgagattagatttttagaggaaaaaaaataggttgactgttttgttttggctatggagatgtattcaagtgcaaacgactccgatttggctatgctggactcaattcggcaatacttactcagcgattcatcggaccttcgactcactgcttccactgattttacctcggctccccccatgttttgcaggagctcaagctttagccgtttgaacccttgtttcactgaaacctggggtgatctcccgctcaaagaagacgattccgaggacatgcttgtttacggactcttacgagatgctctaactgtcggttgggcaccgtccgataactctacgacgaatttaacgccgatcaagccggaaccgcaagaatttttaccgcagacatcgttggaaaaagtggatatggtgacggagaggacggttcctgcggtggtgccggccaaagggaagcattacagaggcgttaggcaaaggccgtgggggaagttcgcagctgagattagggacccggctaaaaatggcgctcgggtttggttaggtacttttgagacggctgaggatgcggctttagcttatgatagagcagcttataggatgcgtggctcaagagctttgttgaattttcctctgagggtgaactctggggagcctgatccagtcagagtaacgtcaaagagatcgtcgccggagccgtcttcgtcttcgtcttctggctccgaaaatgcgtcaccaaaaaggaggagaaaggtggctggctcagctccggcagtggttcacgctgggttagacatgggtgctgga

SEQ ID NO: 16052 - DNA, 897 bp, Gossypium raimondii
  Predicted polypeptide sequence is orthologous to G481, G482, G485, G1364, G2345
cttctagggcttttccctactctttaaatctctccaaaatccccactacgagctaacaataccctcttactcctactatacatatatattcaacttcaactgctctttttcactgtaaaagctctatatcacaataccttattgaactttgagaattgaaggcgatggtggactcagacactgagtcgggaggaggtccaaacaacgcatccaacgcagatctttcttccccgaaagagcaagacaggttcttgccaatcgctaacgttagcaggatcatgaaaaaggctttgcccgccaacgccaagatttccaaggaagctaaagagaccgtccaggaatgcgtgtcggagttcatcagtttcatcaccggggaagcctccgataagtgtcaaaaggagaagcggaagaccatcaacggtgacgatctgctgtgggccatgactaccttaggtttcgaagattacgtcgagcctttgaaggtttacttgcagaggtttagggagatggaaggggagaagaccgccgtagcacgtgataaagacgcgcctcttgctggaggcgtcggtgctgctgctgctgctggttctagtgggatgtatgggatgatggtacaccagcagcatcaaggccatgtgtatggttctggtgggtttcatcagatgggccggggcccaaggtagagtttcttcatcactcacacgtgtatggttgttattaatttgataaaagaaaatctggtttggtttcggttcggcatacttggttgggccggggataaggccttgctaatttattattgggacacgtgcacggttgtgatagcttgtatgtttgaggagaaaggtagtgtctgctttcactttttcacacccttgatttgagggtttagtacta

SEQ ID NO: 16053 - DNA, 863 bp, Gossypium raimondii
  misc_feature (12)..(12): n is a, c, g, or t
  Predicted polypeptide sequence is orthologous to G867, G9, G993, G1930
ctcttttcttcncaccttttgaaagacaaacatttaaaaaccaaccttgttcaactactgcatcctctgcctatatctttttcctgtttgtacaacccaaaagaaagaaaaaaacaaatggatggaggctgcatagccatagatgaaagcacaaccagtgattccatgtccatatccatatcctctcttttacctcccgttaccaaatatcccgactctctctgccgagttggaagtggaaccagcgtgattgtggaatctaaagctgaatctaaaaagcttccttcttccaagtacaaaggcgttgttcctcaacccaatggccgatggggtgctcagatatacgagaaacaccagcgtgtctggcttggaactttcaatgaagaagatgaggccgccaaagcctatgacatagcggctcaaaggtttcggggtcctgatgccgtcactaactttaaacacctccaagaaactgaggaagatggcatcgaaatggccttcctcaatacacattccaaggctgaaatcgttgacatgttgcgtaagcatacttacaatgatgagcttgagcagagtagaacaaggagatgctatggcttcgacgggaatgggaaacgtgtggtaggaaacgaggctgtgtttggctcttttggtgccgaagtgaaagcgcgtgaccagcttttcgaaaaagctgtgaccccaagcgatgtggggaagttgaaccgactagttatacctaagcagcatgcggagaagtacttcccattgcaaagtggaggtgcttcttccaaaggagttcttttgaacttggaagacgtgactggtaaagtttggaggtttaaatattcctactggaatagtag

SEQ ID NO: 16054 - DNA, 760 bp, Gossypium raimondii
  Predicted polypeptide sequence is orthologous to G2
caagatcttcagcttcgttctttaatcctcttctactctatacttacttttttagcttagctgattaactctctcataggcttttccttttttttttttttttttggtctttcagcttttccttggaaaatcactggctttgatggtcattttttaatatttaatttcagcttttatgatagttttttttcttcgtttaaagtagattatgatcatttttttttgagaattttctgctttgaaaatatatagtatcttcgcgatttttagtagctgaaaaagtttgtgaagtgaaaaaaaaatgtgggatcttaacgattctcctgatcgttcaagaggcgaggaatcggaagggtgttcatcgccggtagacggcgaaaaagggaaggggaaacgggttggatccgtttccaattcgagttcttccgccgtggtgatcgaggatggatcagaggaagaagatgcagcagctttaaagaaacgaaacagtaacatgatttttgggttctcggtgcctgtcgagagcggtggaccagctccggtgactcgtcagttttttccacttgaccaagacccagaaatgagggcagttcccaccggaactgcacaagggttccctatggctcactgggtcggagtcaaattccggcaatcggaaccactcgccgttgctaaatccgttgaagctacaaatcccatgaaaaaaagcagaagaggaccaaggtcaagaagctctcaatatagaggtgttactttctat

SEQ ID NO: 16055 - DNA, 630 bp, Gossypium raimondii
  Predicted polypeptide sequence is orthologous to G2
tttaggcttgtttgacaccgagattgcgcttctagggcttatgacagagctgcaattaagtgcaatggcaaagatgctgtcactaactttgatcccagcatatacgacaatgagcttattaattctggtaaaacttcagaaaatgctggagatcacaaccttgacttgagcttggggaattcaaacccaaaccaaaacagtgctaaacctaatgctgataggcaaagtggtacgagttatcagcagcatagtctcccacttgaagcaactgattggcaatgtcggggatttaggtctatgcaggaatctcgtagaattgatgaagctggccatggatatagtgaggaagaaacaatgcagttgttgagccaaactcacattcactctccagctgtctcagttaagtgtaatgaaatgcaaagatatggacagttgaggagacctggaggcaacagtaacatatttcacattgttcctcaacacattaatccatcaccttatcagattcatattccaagaagcagcaatggagggcgaattgggagtgatctttcattatcaactagtgatcaacagtggcaatcaggtcctcaccaccagttgttttggaattctgcagcatcatcagga

SEQ ID NO: 16056 - DNA, 873 bp, Gossypium raimondii
  Predicted polypeptide sequence is orthologous to G4
caatcaccaaaagaaaaatttgcaattaagccataattaattttgccctctaaatttctctaaaaaatctcctaaatcccatactttaaatccaattcgccatgtgtggaggtgcgattatctccgatttcattccgcctgcgcggtcgcgactggtgacggcgaattatttgtggccggatctgaaaaaatccggctctaaaaagcggtcgggtagaaagcactcgaagaagccggcggtcggctttgaagatgacttcgaggctgattttcaggtgtttaaggatgaggattctgatgtcgatgacttcgatgatgatgttgatgatgttttggctgatgttaagtcctttgctttctctgctacagagaaaccctctcctgctgtttctcatggttcaaactccataaaatctgtggaattcaatggtcaagctgagaaatctgcaaaaagaaagaggaagaaccagtatcgcggaattcgccagcgtccatggggtaaatgggctgctgagatccgtgatccaaggaaaggggttagggtgtggcttggaacttttaataccgctgaggaagctgcacgagcttatgatgctgaggcacttagaattcggggtaagaaagcaaaggtgaacttccctgatgagactccacgtacctctccaaagaatgctgctaaaatgaattcccagaaacctctttctgggtcaaatttgagttctgttcaatcaagtctcaacccagatttcagttactcaaacaaacatgagcagggctattatgataccatgggtttcatagaagagaagtcactaatggatcagtttgcatatgcagaccctgttagagctgctgtagatgatgggttaaaac

SEQ ID NO: 16057 - DNA, 825 bp, Gossypium raimondii
  misc_feature (796)..(796): n is a, c, g, or t
  Predicted polypeptide sequence is orthologous to G4
ttctaactctgtaaaatctgtggaattcacacctcaagctgagaagtctgcaaaaagaaagaggaagagccaatatcgaggaattcgacagcgtccatggggtaaatgggctgctgagatccgagacccgaggaaaggggttagggtctggctaggaactttcaatactgctgaagaagctgcaagagcttatgattctgaggcacgaagaattcggggtaagaaagcaaaggtgaacttccctgatgagatgccacgcacctctccaaaacgtgtgattaagacaaatgatgagaaaccacttcccatgtcaaatttgagccctgttgaaccaaatatcaaccagaatttcaattgcttgaacaaaccagagcaggtcttttatgataccatgggtttcgttgaagagaaggcaccaatggatccatttgcttatgtggacactgttcctgctgctgttgatgttggattgaaaccctttggccaatctgacaatacccccttgtatttcagctcagaccagggaagtacttccttcgactgttctgacttcggctggggagaacatggtgcaaagactccggaaatatcatctgctcttgaagctactatggagggtgatgattttctggtggatgcaaaccctaagaagaagctgaaaccaagctctgagaatgttatgcctattgaggacaattcagcagagagtttgtctgatgagctactggctttgggcgatcagatgaagtacccatttcttgagggcaactgggatgccacccttgatgcgttactncatggagatgcaagtcagtatggtggagc

SEQ ID NO: 16058 - DNA, 795 bp, Gossypium raimondii
  Predicted polypeptide sequence is orthologous to G4
gaaacaaatagcagagtttaaaacattcatatgtttttcagtattcaaacataaacaaattcagacacaattacttatacagtcactcaaatttaaaatttagtccaaagtctacaaaaaaacacataaaaaaggggtacatactaaaaacctctgaaagcagtgcaggcaaggcttaagcatgcatatagcttggtttttacttcaacttcacaacagattttgaccaaattctaacatgttgctttatttacaaacactagttattatggaaagttcgctcagaaaacaccctcctccatggtagggaaatcatcaaagttccaaagatccatcgggtttccaccatcctgtgttgcatctccattgaggaaagcatcaatagtggcgtcccagtttccttcaataaatggcggcatttggaagtatttcatctggttgtccaaagccaacagctcgtccgacaaggtcttcgcggagttgtcttcggcaggcataacattgtcggaacttggtttcagcttcttgctagggttagcatcctcaagaaactcatcaccctctacagaagcttcaagaatggatgatatttcaggagttttggcaccctgttctccccagccatagtcggaacaattgatggagttacttccctggtctgaattgaagtacaagggggcattatctgattgattaaatccagcatctatagacataggaacagggtccacgtatgcaaactgattgaccgatggcttctcttctacgaaacccatggtatcaaagtattcctgc

SEQ ID NO: 16059 - DNA, 884 bp, Gossypium raimondii
  Predicted polypeptide sequence is orthologous to G8
ctttgttcttatgttgatgtgcagacgaattgtatctgagtaaggaagaattcgtgcacgttcttcgtcggcagagtgctgtgttttcgagggaagctcgaaatatctaggagtaacgttgcacaaatgcggcaggtgggaagcacggatggggcggttcctaggcaaaaggtgagatacttgttcctaggcaaaaggtgagatacttgtttaaggaaatttaaatttttgcagtcaacatgctgtcatttaggagtatggatgtaaaatgatttgagtgcctcttggtgttgaactgagaatcggtttttcttgaacggattctcagtgggattgttgtttggttttttctccttggatgggaaaaagaaaaaaaaaaatttctaagatgcctatttcaaagaggaaaaataattggggatggtgtttcatggtggggattacgatgcttgcgtgcaggtatatttatcttgggctattcgacagtaaagtagaagcagcaaggtcctagtgatcatgaattactctacctgatactgaatttattaccctgaattctcaacctcaatagggttccatccaacacttgtctaccttttgattttttctggaaatcagggcttatgacagggcagctatcaaaagtaatggacgggaggcagtcaccaactttgagctgagtacatatgaaggggagatggtctttgataccaggaacaaaggcaatagtcacaaccttgatctgaacctggggatatctccgcctgttagcgatggtcccaaggaaaaggaaaatgcggggcatctccaaatgaataacggagagagttttaagggtaacttttgaatcgattattttgaatttacttgtatgtttcatcaca

SEQ ID NO: 16060 - DNA, 833 bp, Gossypium raimondii
  Predicted polypeptide sequence is orthologous to G15
ctccacagtttatttagggtggttatgacatggaggagaaagctgcaagagcatatgatctagctgcactcaagtattggggaccctccactcacatcaatttcccattggagaattaccaaaaagaacttgaagaaatgaagaacatgacaagacaagagtatgttgctcacttgagaaggaaaagcagtggattttcaaggggagcttcaatgtacagaggagtgacaagacatcatcaacatggaagatggcaggctcggatacgaagagttgcagggaacaaagacctttatcttggaacatttagcactcaagaggaagcagctgaggcttatgacatagcagctatcaagttccgaggggcgaatgcagtgactaactttgacataacaaggtacgatgtggaaagaatcatggctagcaatacccttcttgctggagaattcgctaggcgaaacaaagatgtcggacctggtggtaatgacaaccttttaactggtaacaccaatgctgaaaccaacattaacatatcaccaaagaacaatggaggtcaaccagactggaaaatgatcctttatcagtcatctgaacagcaacagcccaacatcattgagaattttaaggctcaggctttctcattggcaccagaaaccatggttggccacagagaggtggatgattccagcaagatagggactactcacttctccaatgcttcttcattggtgactagtttgagcagctcaagagaaggtagcccagagagaagcagtttacctatggcgtttgcaatgcctcctccaccatcatcctagttgatcactacttca

SEQ ID NO: 16061 - DNA, 879 bp, Gossypium raimondii
  Predicted polypeptide sequence is orthologous to G19
gtagagctttggttctctgtccgctgcttctttcttcccttggtacttcattatttttcctttcacttcctttttgtgaaaaaacattgaaacccttttcaagacgcaatagaagatgtgtggaggtgcaatcatttccgatttcattgccgtgaaacgcggtcggaagttaaccgccgaggatctttggtctgaacttgacacattctccgacctgttgggtctggattacggaaatggaaaagaccctttctctcagttcgacaacaccaaggccggttccaaagccaagaaccttgaaaaagtgacaaacgagtcgactcagaagacaagccgggggagagagaaagaagggaagactcagcgaactcgaaagaacatttacagaggaatcaggcaaaggccatgggggaaatgggcggctgagataagagatcctcacaaaggtgtccgagtctggctcggtacatacaacacggctgaagaagcggctcgagcctacgatgaagccgccaagcgcatccgcggggacaaagccaagctcaacttccctcaaactccacgcctaactcagcctcctgctaagaaaaggtgtatgatggctcctgagttgactccaccgagttctgaaaccaagagctcaccaaccccacaaccttttatgggttttggttacgagaatggagtttacaggccgagtgaagcaatggaaagcgagatggagctgaaggagcaaatctcgagtctggagtccttcctgggtttggagcctgatgagatgacaactgagttgagtggaagcgctgagcctgagtcagtgaacctttggatgcttgatgaccttgtgacacatcatcaacaacagcctcagctctttta

SEQ ID NO: 16062 - DNA, 904 bp, Gossypium raimondii
  Predicted polypeptide sequence is orthologous to G43, G46, G1419
gccatcttctgaagaaacattagccttggaactcattccagaacatcttcttactgactttgcttccatggattcttttcttgccagtcttcatcatatagtggaagccccacaattctctcaaatccatagccccaatcagatgaaacagtctactctaagccaacgccgtccttctataaacgtcgccattcccgcaccgaaagtgaacgtaagcgacgagcagaggcattacaggggtgttaggagacgaccttggggtaaatttgcagctgaaattagagacccccacagaaaaggtgcgagggtttggctgggaacctttgataccgccattgaagctgctaaagcttatgatgaagctgcgtttaagcttcgtggaagtaaagctatattgaattttcctcttgaagctggaaaatcaagttcagcccactctgaattaactaaagcttgtataaaaaggaaaagagaggaggaagaagaagaagggagagtggagagtaaagtagtgaaaagagagaaggaggaaaacgcggtgaaggagacgggaagtgtgacgccgggagtatgtttaacgccgtcaaattggacggggttttgggatagtgaagatatgaagggaatattcagtatccctcccttatctccgttatctccgtttgggtattcagggcttgcggttatgtgaaacgcttttggtgggttttggacgccgttaactaaaatcaggaatggttggctgacgtggctagttcaattatccgaagatagaaatttgttcaatcattagtgtacatactctacattgcggcccaagccttttgttttactataacattctatttcttcttttattttttttttagtgaatgataatttttaagtgattaatgttatttac

SEQ ID NO: 16063 - DNA, 844 bp, Gossypium raimondii
  Predicted polypeptide sequence is orthologous to G43, G46, G1419
ttccccttttttagtctccaacttccatttttcttgtcggtgttgatatcataaataccaaaatggcacgttctgaagaaacatcagcccagttagaacttatcaggcaacatctctttactgattttgcttccatggaaactccaccacccttctatcaactctcaaattccgagtcatctcatgtttatagcccgacccggttaaaacaatcgagtctcagccaacgtcgtccttctattaacgttatgatcccacccacaagttttaacataggcccaaacccggttccagattcggctgcggtggcggttgaatcatacgagaaaagtcattatagaggtgtcagaagacgaccatgggggaagtttgcggctgaaattagagaccctaacaagaaaggggcaagggtttggcttggaacatttgacaccgccatagaagcggcaaaagcatatgatagagctgcctttaagctacgcggtagcaaagctatactgaattttcctcatgaagctggaaaatcaaatttctcagagtcagggaaaaggaggagaaatgaagaggaaggagaaggagaaaagagagtgagcctgttggagtccaaagcagggagaagagaggaggaggtaacggtggcagaatgtggaacgccgtcgaatcagacggggatcggggataatgaagatataaatgaaatattcggcggcccactcttatcacccttatcatcgtttccatggttcgggtattccaggcttgaggttatgtaaaagcttagcaaggaatgtggctgtgtttactttttaagtgtttagtaatgagtaaggatgggatgcctaaa

SEQ ID NO: 16064 - DNA, 829 bp, Gossypium raimondii
  Predicted polypeptide sequence is orthologous to G129, G136, G140, G146
gagaagtaaataaaaaaacccttctctttctttttccgcctttaattatcatacttgcctttttcttttcttttcctttcaagttaggaagcatggtgtaccccaatgaatcccttgaagactttccccagaagaaaatggggagaggaaagatcgagatcaagcggatcgaaaacacgacgaaccgccaagttaccttttgtaagaggcgcaatggtttgctcaaaaaggcttatgagctatcagttctttgtgatgctgaggttgctttgattgtcttctccaaccgtggtcgactctatgagtatgccaacaatagtgttaaagcaacaattgaaaggtacaaaaaggcttctgattcctccaacactgggtcagttgctgaagttaatgctcagttctatcagcaagaagctgacaaactccgaaatcaaatccggaatttgcagaatataaacaggcacatgctgggggagtccgtagggggattgcctatgaaagagcttaagagcttggagagtcgtttagaaaaaggaattaacagaatccgttccaaaaagaatgagctgttgtttgctgaaatagagtatatgcagaaaaaggaaattgacttgcataacaataaccaacttcttcgagccaagatagctgaaaacgagaggaagcagcagagcatgaatttgatgcccggaggttcaagtaataacttcgaggacatacattctcagccatatgactctcggaactacttccaagttgatgccttacaacccgccgccaattattacaaccctcagcagcagcaagaccagatagttcttcaactagt

SEQ ID NO: 16065 - DNA, 689 bp, Gossypium raimondii
  Predicted polypeptide sequence is orthologous to G133
ggaagatccagatcaagctgatagagacacttaacgaacaggcaagtcacgtattcgaagagaagaaacggtcttttcaagaaagctaatgaacttacagttctttgcgatgctagagtttcgatcatcatgttttccactactggtaaactccatgagtttatcagcccttccaccacaacgaagcaagtaattgatcagtaccagaaaaccttggggatcgatatctggaacacccactatgagaaaatgcaagagcagttgaagcagctgaaagaggttaacaggaacctgcgcaaagagattaggagaaggatgggcgactgtttgaatgatttgagcatcgaagatcttggtgctttggaacaagaaatggagagctctgtcactcttattcgtgatagaaagtatcgtgttctctccaaccagatcgatacttccaggaaaaaggtgaggaatgtggaagagatacacaaaaatctcttacatgaactggaatccctgaaagaagatccatatggattagttgataatggaggcgattatgataccctgatcgggtatcaaaatggaggtcctcgtatatttgctttacgcctgcagccaaaccatcctagccttcacagtggcggaggctccgatctcaccacctatcccttgcttgattaaatatctatctcgccatgatt

SEQ ID NO: 16066 - DNA, 901 bp, Gossypium raimondii
  Predicted polypeptide sequence is orthologous to G137, G145
caaaaaaaaaaaaaaaaacaggtgaaatccctttttcttttggtctcaaaacaattcaaaagggaaagattgttggttttagggtttgggttctcattgatttttagtgaaaaaattataaaaaaaaaattatgggaagaggtagggttgaacttaagaggattgaaaacaagatcaacaggcaagtcacttttgcaaagagaagaaatggtcttttgaagaaagcttatgagctttctgttctttgtgatgctgaagttgctctcatcatcttctccaatagaggaaagttgtacgaattttgcagcagctcaagcatgatcaaaacattggagaggtaccaaaaatgcaactatggagctcctgagccaaacgtgtcatctagggaggctgctttggaattaagcagtcgacaggaatatttgaagcttaaagcacgttacgatgccttacaaaggtcccaaaggaatttactaggagaagatttgggacctttgagcagcaaagagctcgagtcacttgagaaacaacttgattcatcattgaagctaatcagatcaacacggacccaatacatgcttgatcagctcaatgatctccaaagaaaggaacatcttcttaatgaagccaataagaccctaaaacaaaggttggtggaagggtaccaagtaaactcgttacaattgaatccaaatgcaacggaagacgtcggctatggccgtcaacaggttcatcatcagcctcatggcgatgccttcttccatccactggactgtgagccaactttacaaatcggatatcagcatgatccaatgtcagtggtgactgcagggcccagtgtgaataattatatgacaggttggttaccatagcatatatatctctatatatctatataaag

SEQ ID NO: 16067 - DNA, 829 bp, Gossypium raimondii
  Predicted polypeptide sequence is orthologous to G184, G186, G916
cgcctttacagattttggatctaagccgttcctcggctgccggagcagaagcggcggagacgatatctcattcgtcgtcggaagaaaggacacgttctgggacacctccaagtaacgtggagaagagggtgaatagagaagaaagcccggaatctgagagttggggaccaaattgtaaagttcaaaaactgagttctgggaaacctgttgatcaatccactgaagcaaccatgaggaaagctcgtgtttcagttcgagctcgatcggaagctccaatgattactgatggatgtcaatggagaaaatatggtcaaaaaatggcgaaaggaaacccatgtcctcgagcttattaccggtgcaccatggccgtcggttgtccggtccggaaacaagttcaacgttgtgcggatgatagaacaatattgataacaacttacgagggcaaccacaaccacccacttccaccggctgccatggcaatggcatcgacaacggcagcagctgctagcatgttgctgtccggttccatgccgagtgccgatggaatcatgaaccctaacttactagccagggcaatccttccttgctcctcaagtatggctactatttcagcttctgccccattcccaaccgtgacattggaccttacacactcgccgaaccctctgcaattccaacggccaccacccccgccgacacagttccaagtcccatttcccggccaaccggcgccggtgtccgcccctcaattacctcaggtttttggccagccattgtacaataataatcagtccaaattctcaggcttgcagttatctcaagaaatggg

SEQ ID NO: 16068 - DNA, 854 bp, Gossypium raimondii
  Predicted polypeptide sequence is orthologous to G207, G227, G230, G242
ctattgcatgcctttaaatttgatttcactgtatgtaacaagcacaccggatagaaaagaaatggatcggatcaaaggtccatggagccccgaagaagatgagttgctccagcagctggtacagaaacatggccccagaaactggtctttgatcagcaaatcaatccccggccgatccggtaaatcctgtcggctccgatggtgcaatcaactgtcaccgcaagttgagcaccgtgccttcaccccggaagaagacgagaccatcatccgagcacatgccaggttcggtaacaagtgggccaccatagcccgactcctcaacggccgtaccgacaacgccattaaaaaccactggaactccacgctaaaacgtaagtgcttgccggttggggaagagtgtaatttcgttgctaatggagggtatgatggtaatctgggaggagaggaacggcaaccgttgaaaagatcggtgagtgctggtctatacatgagtccagggagcccatcgggatcggatgtgagcgattctagtgttcccgtcttatcgtcttctcacgtgtacaagccgatcccaaggaccggcggtgttaacgttgatgtaaatgttacgccagctggagtggaagcggcatcatcttccaacgatccaccgacctcactgagtctgtctttaccgggggtggagtcatgcgaggtggtgtcaacccagccaataaccgagtcaactcagaatcggagtgaagaaaggggaggtggggtgatggggttcagtgtggagtttatggcggtgatgcaagagatgataagggttgaggtgaggaattacatgacccagatgcagcaacagcagcagc

SEQ ID NO: 16069 - DNA, 814 bp, Gossypium raimondii
  misc_feature (774)..(774): n is a, c, g, or t
  Predicted polypeptide sequence is orthologous to G274
cgggatatgcgattggttactatttttaaaaaatggcattgaaaccgaattcaccggatggtagaacaaggagttggcttcagatatttatcgtttttggattatgttgttttttctacatattaggagcatggcaacgaagtggtttcggcaaaggggatagcatagctttagagataaccaaacacggcgccgattgtaacatcatcccgtcgttgaacttcgaaacccatcacgccggcgaagtggggaacgtcggtgaatctgaaaagatcaagtcttttcagccctgccctcctcgttacgttgattacacgccttgccaagatcaaaagcgtgccatgactttccccagggacaacatgatctatcgggagaggcattgtcccagggaggaagagaagttgcattgtcttgtcccggcacctacaggatacgtgaccccgtttccttggcctaagagtagggactatgtgccttatgctaatgctccctataaggccttgacggtagagaaggctattcagaactggatccaatatgagggtaatgtattcaggttccctggtggaggaacgcagttcccacaaggcgcggataagtatattgatcagcttgctgctgtgatcccgattacgaacgggactgtaaggactgcacttgataccggttgtggggttgcgagttggggggcatacttgtggagtagaaacgtccttaccatgtcgtttgcaccaagagattcacatgaagcacaggttcagtttgcccttngaagaggtgttcctgctgttattggtgttcttgggaccat

SEQ ID NO: 16070 - DNA, 896 bp, Gossypium raimondii
  Predicted polypeptide sequence is orthologous to G274
gttctttctttcttcctttcttctggcgtactttgggttcccactctaatcatggtatccaagcacaatccatcgggcaacaaaaaacggagcccactatctatatttgctgttattggtttgtgttgtttcttctacattctgggagcatggcagcgaagtggttttggcaaaggagatagcatagcattggaagtaacaaagcaggcagactgcagtatcttcacaaatttgaactttgaaacacatcacaacgatgtagagattgttgagccttccaaaccaaaagctcaggtgtttaagccgtgtgatgtaaaatacactgattacaccccttgccaagagcaagaccgagccatgaagtttcccagggataacatgatttaccgggaaagacactgtccccccgaagaagaaaaactacactgtctcattccagcacccaaagggtatatgacaccatttgaatggccaaagagtcgtgactatgtccattatgctaatgttcctcacaaaagcctaacagttgagaaggctgtccagaactgggtacagttcaaaggaaatgtgttcaaatttccaggaggaggaacaatgttccctcaaggtgcagatgcgtatattgatgagcttgcctctgtcatcccgatagcagacggttctgtcagaacagcattggatactggttgtggagttgcaagttggggtgcctacatgctgaagagaaatgttctggctatgtcttttgcacctcgggacaatcatgaagcacaggttcagtttgcactggagcgaggtgtgcctgctgtaattggtgttcttggatcccattaatctccatatccatcaagagcatttgatatggctcagtgttctcgatgcctaataccatggac

SEQ ID NO: 16071 - DNA, 654 bp, Gossypium raimondii
  Predicted polypeptide sequence is orthologous to G274
gaagaaaaataaacttgtttattggcattcatcactatgctttcttggatcttgacataattatttgggcagctacccaaataatggaaaaaaacactatttcctcccaaaatcacactcaggattacaagctaacataattgggtatattctctacatagtgaataacacaatggagcaacttaagtatctttttgagggttgttgatcggaactcttcagtccctctgtctgaaccaacttcaccatcagttcgagattttaacctttgctttttagttttaccttgaaatacttgacctgttgatgttggtttattcagcactggatggactgtttcctttgataacaccaacccagtactgtttaactgcaactaaaattttctctggcacaaggggaccatcctcgtgatcattcatcttggggtcccatctcatgcctccagcaattttcctaaccttgtttaggacatcgacatcatcccggaatatcacagccccttcaggccgtaaaatgcgatccatttccagaaggatgtcttcaaagctacacttatcttgatacaagctaaagacaccattagcatgaataagggcatatgttcttggatacgtaaagaaaccttcgcaccagtcatgatatattccaatt

SEQ ID NO: 16072 - DNA, 896 bp, Gossypium raimondii
  Predicted polypeptide sequence is orthologous to G275, G837
gggatcaaagatgaacatgaagctcaagtacaatctgtacttgaaaggggaattcctgctgtgtctgctgtgatgggtactaagagacttccctaccctggcagagtatttgatattgttcattgtgcacgatgtagagttccatggcacatagaaggtggtaaactcctcttggagctgaaccgtgtcctgcgacctggtggtttctttctgtggtctgctactccaatttatcaggacaagactgaagatgttgaaatctgggaagctatggttgaactaacaaaatcaatgtgctgggagcttgtaaacaaaactagtaaggatgcagtaaatggggtggctgtagcagcatttaggaagcctacttctaacgactgctacgagcaacggtcaaaacaagagcctccagtctgtcctgagtctgatgatccaaatgcggcatggaatgtgcccctgcaaacttgcatgcacaaagtgccagtagatgcttcagaacgtgggtctcagtggcctgatcgatggccagaaaggttggaaaaagcaccttattggttgagttcccaagttggagtttatggcaaagcagcaccagaggattttgctgcagacaatgagcactggaaacgggtggtaactaagtcatacctaaatgggatgggaataagctggtcatctgtcagaaatgtcatggacatgaatgctgtttatggaggatttgctgctgcactaaaagatttgagtttatgggtcatgaatgtggtcccaattgactctccagatacacttcccataatatatgaaagaggtctatttggcatgtatcatgattggtgtgaatcctttagcacctatccaaggtcttacgatcttctccatgccgaccatctattctc

SEQ ID NO: 16073 - DNA, 831 bp, Gossypium raimondii
  Predicted polypeptide sequence is orthologous to G291
gaaacatgggaactagaaaacaatatacttaccgtcaagacacctgacccttcatcggattctatattctactacgacgaggcggctcaagccaagttccagcaagagaagccttgggccaatgatcctcactacttcaagcgcgttaagatctctgcgctcgctctccttaagatggttgtccacgcccgatctggtggtaccatagaggtgatggggctgatgcaaggcaagaccgacggcgatgctatcattgtcatggacgcctttgctttgcctgttgaaggcactgagactagggttaacgctcaggcggatgcctatgagtatatggtcgattattcccagaccaacaagcaggctgggcgattggaaaatgttgttggatggtaccattcacatcccgggtatggatgctggctgtccggtattgatgtttcaacccaaatgcttaaccagcagttccaggagcccttcctggcggttgtaattgacccaacaaggactgtttccgctggaaaagtcgagattggagctttcaggacataccctgaaggatataagcctcctgatgatcctatctctgaatatcagaccattcctctgaataagattgaagactttggtgtgcactgtaaacagtattatgcattggacatcacttatttcaagtcctcacttgattgtcacctcctggatctgttatggaataagtactgggtaaacaccctttcttcttcacctctcttgggtaatggagattatgttgcaggacaaatttcagatttagctgaaaagctggagcaagcagagaaccaactggctcactct

SEQ ID NO: 16074 - DNA, 863 bp, Gossypium raimondii
  Predicted polypeptide sequence is orthologous to G307, G308, G309
ggtatgcaatgggcgcagctttaatgccagtacttgcattaagacacggtggaccaccggcgtttcgaccgaccggaattggaccgcctcaaccggataatactgatgcgttgcaacaagtggggtggaagctagctcaattggccgaacgcatcgggatcgaattcgagtttcggggattcgtggctaatagtttagccgatctcgaacccgaaatgctcgatattcgtcctcccgagattgaagtagtagcggtgaacgctgttttcgagcttcatcccttgttagctcgaccgggtgggatcgaaaaagttgtttcctctattaaagcgatgaaacccaagattgtcacggttgttgaacaagaagcgaatcacaacggtccggttttcttagaccgttttactgaagctctccattattattctacccttttcgactcgttggaaggttcaggggtggcgccaccgagtcaagacctggctatgtccgagttatacttaggaagacagatttgtaacgtggttgcttgtgaagggatggaccgagttgaacgacacgagccattgactcagtggagaactcggatggaaacggccgggtttagccctgttcatttgggttccaatgcttataaacaagctagtatgttgttggccctcttcgccagcggcgatgggtatagagtggaggagaataatgggtgtttaatgcttgggtggcatacaaggccacttatcgccacctcggcttggcgactcgctggtactgagtcaggtagtgagttaactcaggagctgagttgagaaaaagtaaaaaacctgttgaaaagaataagtggggtctatcttttaactgagttg

SEQ ID NO: 16075 - DNA, 848 bp, Gossypium raimondii
  Predicted polypeptide sequence is orthologous to G386, G707
gatcgtactaagcgccgccacttcggtttcgttgccggtgtcaccgcaacggcttttcgatttcctacgcgacgaacggttgaggagcgagtgggacatattgtcaaatggcggacctatgcaagagatggcacacattgccaaaggccaagatcatggcaattgcgtttccctcctgcgtgccagtgccatgaacgcaaatcagagcagcatgttgatattgcaggaaacatgcatagacgcagcagggtcgcttgtagtgtacgcgccagttgatattccagccatgcacgttgtcatgaacggtggtgattccgcttacgtcgcacttttaccttcgggattcgccattgtcccggacggtcctgggtctcatggacctatctctaacggacatgttaacggaaacaccggcggagggtcgtcgagagtcggtggatcgcttctcacggtagcttttcaaatattggtaaacagtttaccaacggctaaactgaccgtcgaatcggttgaaacggttaataatctgatttcgtgtactgtccaaaagatcaaagctgcccttcaatgcgaaagttgatgactcagtgagttgggtaattttagttattaatataggttttggttgtggttaaagagtgcgactcagtaagttgggacgagtgggggtattgagtcaagaacgaaccgcgcgtggagaattattgtatggtgatgatcaaagggacaagggtggtggttcgggtattgactcaagtcgaccctttgagttggctcgccgggaccagaaaagaaagtcaaaactcaaactgcgtcgtatttggtgtactaatccaatttctctttcc

SEQ ID NO: 16076 - DNA, 899 bp, Gossypium raimondii
  Predicted polypeptide sequence is orthologous to G388
aactgagaacagtaataggaaaataccctccgggtgcatcaacgactggttcatgttcatctgaaaatgaccaagaaaacaggagttcattggatttttacactgggattttcggacttgaaaagtcgagaatcatggagattgtaaaccaagccatggaagagttgcaaaagatggctacggctggtgaaccgctgtgggttcgaagcgttgagacgggtcgggagatacttaactacgatgagtacgtcaaagagttctctgttgaaagttcaagcaatgggaggccaaaaagatccattgaagcctctagagagactggggttgtttttcttgatctcccgaggctggtacaaagcttcatggatgcgaatcaatggaaggaaatgttcccatgcataatctcaaaggctgctactgttgatgtgatttgccatggggaagctccgaataaaaatggtgctgtacagttgatgtttgctgagctgcaaatgctcacacccttggtgcctaccagagaagtgtactttgtccggtactgcaagcaattgagtgctgaacaatgggcaattgtcgacgtttctattgacaaagttgaagaaaatatcgatgcatccttagtgaaatgcagaaaacgtccttcaggttgcatcatccaggataaaaccaatggccattgtaaggtgatttgggtggaacaccttgagtgccagaaaaacactgttcacacgttgttccgtaccattgttcgcagtggactagcatttggtgcaaggcattggatggcaacattgcaacatcagtgtgaaaggctcgttttcttcatggcaaccaatgttcctaccaaggattttcactggtgtgcaacattggctgggaggaagagtattttgaaattg

SEQ ID NO: 16077 - DNA, 690 bp, Gossypium raimondii
  Predicted polypeptide sequence is orthologous to G409
gattggtattttttttttattacttaattcataattattagtacaagaagtaataatacacaaacaacatcctatatttatttatgtatgtatgtaacatatagatgtgtaacttaataagccgaaaaccagaaagcatgatcttcaacatgaaatccataactacaagaacttgcagggggggcggagtaatcattgtcttccaattttgggaaaatgtaaaaagatggttgaaacaaagccttactcaagttatcttcctcatcttgggatgtatcaaactgatctggttcgaatggataaaatgaatgagggctgtctgaatcaacaggcttttgggggggttcttgacacactgggttcacatccgataactctgagttgttcttttctttcataaccaacttatcagtaagctgaagaacctcctgtttaagtttatctttctctttgaggagattaccataatcatctttgagggtattaaagctagcttggaaagtgtcatagtctttttcaagctgcttagtcttccatcgagcacggcggttttgaaaccaaatggcaacttgacggggttgtaacccaagttctttagctagttgagttttcctttcaggttcaagtttgttttcaacctccaaacttttctctagaaactggacttggtcaacagtgagtcgtcttttc

SEQ ID NO: 16078 - DNA, 697 bp, Gossypium raimondii
  Predicted polypeptide sequence is orthologous to G409
ctttttttaaaacccaaacaacatcatatatttatttatggatggatggaacatataaatgggtaacttaataagccgaaaaccaaaaagcatgatcttcaacatgaaatccataactacaaaaacttgcagggggggcggagtaatcattgtcttccaattttgggaaaatgtaaaaaaatggttgaaacaaagccttactcaagttatcttcctcatcttgggatgtatcaaactgatctggttcgaatggataaaatgaatgagggctgtctgaatcaacaggcttttgggggggttcttgacacactgggttcacatccaaaaactctgagttgttcttttctttcataaccaacttatcagtaagctgaaaaaccccctgtttaagtttatctttccctttgaggaaattaccataatcatctttgagggtattaaagctagcttggaaaggggcatagtctttttcaagctgcttagtcttccatcgagcacgggggttttgaaaccaaatggcaacttgacggggttgtaacccaagttctttagctagttgagttttcctttcagggtcaagtttgttttcaacctccaaacttttctctaaaaactggacttggtcaacagggagtcgtcttttcttcccggggtgatgaaaatactcatcaagatcttcctctccattctcttcttc

SEQ ID NO: 16079 - DNA, 865 bp, Gossypium raimondii
  Predicted polypeptide sequence is orthologous to G427
ctccaccgccgcggctcaccaagccccccattagtggctatcgcgctcgtcgtcttcgcttcttcaacgcttccacagcgatgtcatccaagacgtggcggccaccgcagctgcagcagcaggaggtggtggtggggactccatggtcgccgtggaatctggggaattgaagaacagcaacagcgagaccatgaacaagagcgaaggcgtcgtggtgcaaagcggaggagatgcggcggtgaattggcaaaatgcgaggtgcaaggcagagatattagcccaccctttgtacgagcagctactgtcggcgcacgtgtcgtgtcttaggatcgccacgccggtggaccagctcccgaggatcgacgctcagctggatcagtcgcagcacgtggtggccaagtactccgctctcggcggcgcagcccagggcttggttgcggacgacaaagaactcgatcagttcatggagtttcaccgggggaaggtacgggggcaacaatgtcagatgatgatgaagaccaagtggagagtgatgcaaatatgtttgatgcaagtttcgacggtcctgattcaatgggatttggccctctcatcccgacagagactgaaaggtctttgatggagcgtgtgagacgggaactcaaacacgaactcaaacagggttacaaagagaagattgttgacataagggaggaaattttacgtaagagaagggcaggaaagcttccaggggatacgacgtcggttttaaaagcttggtggcaggcacattccaagtggccataccctactgaggaagacaaggcaaggttggttcaagaaacagggttacaattaaaacagataaacaattggtcatcaatca

SEQ ID NO: 16080 - DNA, 885 bp, Gossypium raimondii
  Predicted polypeptide sequence is orthologous to G427
tacaaattcaataccgtgtctttaagctatgattgtaagaaaaaaagggggaaaaaaacaatcttttcaatcgtgtccttggatttcgctgtcctttgttgtaatctccttctctatatcagaccatggaacagtaatcatcatcatatatagctttcgaagacgtttttacaggaagaaaaaagggataaaggtgaagggggtagtcatggcgtttcaccataataatcacctttctgatcatcatcaggaccttcctctccatcaccttaccgagcaccaccaccagcaggcgagtcaactgtcggaaaccaacggtccaaattggttgaacaccgccctcctccgttcacagcagcctcaaccggcgcaaccacactcttcccagttctccgagcctaactttcttaaccttcatactacgagagctgcttctgattccaccacgggttcccaagctccgaaccagtggctctcccgtacgtcgtcttcccttcttcatcgcaaccacagcgacgtcatagacgacgtaggtgccgccgcggaagctgcgagaggaggcggaggggaatccatggtcgccatggaatcgggcggcagcggcaacaacaacggtattatgaacaacaacaagagcgaaggtgttgtggtggaaagcggagggggcggtggggatggggtcgtgaattggcagaatgcaagatacaaggcggacatactagctcaccctttgtgcgagcaactcttgtctgcacacgtggcgtgccttagggtcgctacgcctgtggatcagctcccgaggatcgacgctcagctggctcagtcacagcatgtggtggctaagtactcctccctcagtggtgggtcccagggcgtggttgccga

SEQ ID NO: 16081 - DNA, 921 bp, Gossypium raimondii
  Predicted polypeptide sequence is orthologous to G447
cagcagcagcagcagcagcaatcatctcaacaattactctccccagctggatcactgttgcagcctcaaatgttgcagcagcagccgacccatcaacagagccaaccattgcagcaattgcctctttcacaaagccaatcacaacctcttggcagcaatggcttctcaacatcaatgcctgttcaacctcaacaggtttcagtgaaccaaccccaaattcacaagccatttactgctatgagaactcattctggtcttactgacggagatgctccatcatgttcaacctcaccttctaccaataactgtcaggtttcctcgttgaactttttaaacaaaaatcagcaagttccatccttattggtgtcagatcctcttgttgagcctgcaagtaccctggttcaagagcttcagagcaagcctgatattagaatcaaacatgaactacccacctctaaaggaccagaactatcaaagtacaaaagtactgtgacagatcaattagaagcatcctcttctggaacatcatactgcctggatgcgggcaccaaccagcataatttctccctccccacctttttggaaggtgatcttcaatcacactcccggaacaatcttccttttacagcaaatattgatggattggcacctgacactttgttatcaaggggatatgactctcaaaaggatcttcaaaacatgttgtcgaactatggtggcaacccaagagatattgatgcggagttgtctactcctgcgataagctctcagtcgtttggtgtgccaaacatacctttcaagactgggtgctcaaatgatgttgctatcggtgacacaggagtcctaaatggtggactgtgggccaaccaaactcaacgcatgcgaacatattcaaaggtgcaaaagcgtgggtctgtagga

SEQ ID NO: 16082 - DNA, 858 bp, Gossypium raimondii
  Predicted polypeptide sequence is orthologous to G450, G456
caacgttatcatatattcccccctcctacttcctatttctctagcaaatacactatcaagagagagagaaaagagagacattttgtgacgaaaaaaaaaaaaaaaggaaaaggactaaagttggatggttgtagggttttgcacgtaaaagctcgtgtttaatcatcataatgactagcattatgggcacagaggatgataagtatagcacgattaacttcgaagagacggagttgcgtttagggttgcccggcgccaacggaaacgacggtgaaactaccaaaaacaacggaaaacgagggttctcggagaccgttaatttgaagcttaacctttcatcaaaggagactgtagccgaggattccgagaagatgaaggagaagagctcaactgaccctgcaaagccacctgccaaggcacaagtggtgggatggccaccagtcaggtcattccggaagaacatcatggccgtccaaaaagccagttccgaggaggaaggtggcagcaagaaggccggaaacagtgcagccgccactactaccaccacggctgcggcgtttgttaaggtcagcatggacggtgcaccttatctacgcaaagtggacttgaaactatacaagagttaccaacaactctctgatgccttgagcaaaatgttcagctccttcactattggtaactgtgggtctcatggaatgaaagatttcatgaatgagagcaaattgatagaccttttgaatggttctgagtatgttcctacttatgaagacaaagatggagattggatgcttgttggagatgttccatgggagatgtttgttgattcgtgcaaacgcttacgaattatgaagggatctg

SEQ ID NO: 16083 - DNA, 856 bp, Gossypium raimondii
  Predicted polypeptide sequence is orthologous to G450, G456
ctaaaccttcctatattcctattcctcttcttatcatcactctctcaatcctttgcttattacaacaaaacctttttcttctttatttttcacctttcagttcaaatcatcaaacccagaaagcgtggctacaacaaactgcaaaaaaaaggaaacaattagagaaagaagctatggaagttggcttaaagatgacgatgaaaggaggcggaggagatcatgttggaggttgcgacaaagagaagatggggtttgaagagactgagctgaggctagggttgcctggtggtggtggtggtggtggtgacggtgaagttgtgaggaaaagaggcttctctgaaactgttgatttgaagcttaacctttcctccaagcaagacacctctgggatcgatcccaatgatgagaaagtgaaaggcttgcaccaggagaagaatcttctcctttctgccattgatcctgctaagcctcctgccaaagcgcaagttgtgggatggccaccggtccgatcattccgaaagaacatgttagccgccaccacacagaagagcagcagcgaggagagcggcgagaaggcggcgctggtgaaggtgagcatggacggtgcgccttacctccgtaaggtggacttgaggatgtacacaagttaccaccaactctccgatgctttagccaaaatgttcagttcttttactatcggaaattgtggatctcaaggaattaaggatttcatgaatgagagtaagctgatggatctccttaatggctctgattatgttcctacctatgaggacaaggatggtgactggatgcttgttggtgacgtcccttgggagatgttcgtcgaatcatgcaa

SEQ ID NO: 16084 - DNA, 864 bp, Gossypium raimondii
  misc_feature (744)..(744): n is a, c, g, or t
  Predicted polypeptide sequence is orthologous to G470
ccaacatcatctaattacgagaatcctatccaatcaagagatttaatgccaaaagcttcattgggacaagatcatgagaacggaaaatctagagaaggaagttgcaagctctttggtattcctctcattagtaattctgttgcatcagagcccaccgtctctcctattaatgccacgaacaaggcagcaagtcatgtggaagctgcaccaaaccaagctcgtacatttacgtttgatcaaaagtccgagcagccaaaattctcaccgttggcagagaatctgtctatttttaatgagcaggagaaatcgtttcagccgggtcagcctcatacaagagaggttcaaagcaaatctcctagtgcttcaactaggagttgtacaaaggtcctaatgcaagggagtgctcttggtaggtccgtggaccttactaagttcaacaactacgatgaactgattgctgaattggatcaattatttgaatttggtggtgaattaatggcccctaaaaagaattggcttgtcgtttatactgatgatgagggtgatatgatgcttgttggagatgatccctggcaggaattttgcaccatggttcgcaagatcggtatctacactagggaagaggttcagaagatgaagccggggtcattgaattcaaagggcgaggacaatctggtttctgcggaagggctagatgcaaaagacgtgaaatgtacatcagcatctagtacagagaattgttanagctcggctctaataattccgggtaatataatgggcgtgtataattgcatataagtatcgaaccttgttttaatagggagaagaaactgatcagatgaacatataccatgttattacatg

SEQ ID NO: 16085 - DNA, 894 bp, Gossypium raimondii
  misc_feature (871)..(871): n is a, c, g, or t
  Predicted polypeptide sequence is orthologous to G470
gtgatgtggccaccttcaatagatgatgcgatgattgatgtagctcatggtgaaagaaaatttgggccagagaattggatgccctctaggaggcatgaaccaacttacacagatttgctctcaggttttgggtcgaatgctgatacatcgcgcggatattatccttcctttgttgatcaaacttcagtagctggtaattcggggaaaaaacaattactaggtcaagaagggaagcttggctcttggtccctcttgccatctggtctctcactcaagttgtctgacagtagtacagaccctcctttgcaaggttctgatgtgccttatcaggcgcggggaaatggtagatttagtggttttggtgactaccctatacttgaaggtcataggattgaatgctcacgtggtaattggttgatgcctcccccaaccacttcttgttatgataattcaatccattcaagagatttaatgccgaaaacatcattggctcaagagcataagaatggaaaatctagagaagggaactgcaagctctttggtattcctctcataagtacctctagcgcatcagagcctgcagtctctcatattagtgctttcgccaagcctgtaggacatatgcaagctgcattgcaccagtttcatgcacttgaatctgataaaaggtctgaaaattcaaacgcctcccagatggcagaggatgtttctgcttttaatgagcaggagaaaatagtgaagctgggtcagccccatgcacgggagtttcaaagcaaactgtctactgcttcaactaggagttgtactaaggttctcatgcaggggactgctcttggaaggtctgtggaccttactaagttcaacaactatngatgagtgatcgctgaattggat

SEQ ID NO: 16086 - DNA, 736 bp, Gossypium raimondii
  Predicted polypeptide sequence is orthologous to G477
ggtcatcaaaacatttttaattccagaaatgttgataattttgttcatcaaaacatttttaattcgagaaacataatcaaacaattttttttttcgattacaaaataacttgtaaaagtctaggtgaaacttaaccgaggggggggggggggaatcctgttagcagctgctgaactttctcatcatgcttccatctatgttactccgactatttggacatctcgagaactgtgcagctttcagcaacattgaacttgtcttaatctgtacttaaatgattcggaggcagggctcattttcattggcttcttgcatagattgtctttgatgttccactcgctgaagctgcgatgaaagctgaagcaagttgatcgttggtccatctttgcatgatagtccatcagtgatattgaagttggcagcttcactactatcagatatcagtatagcacccatgttactgccttcggttgaattgatccctgatgaagagatcgtattcaacactctgtcgagcttttccgagacttgagtcatgtgatggttatggtagcctggaataaccagggaacgggccatgggaattcctgatgagtggcttgaagagctgtgtgattgagatgacagaagagagagagcacaaacagaatccgaaatcccagataatccctgaatgctcaatgctgcatcgaaaacattgatgtcttcacttgctgacgaggaggtgccttggaac

SEQ ID NO: 16087 - DNA, 861 bp, Gossypium raimondii
  Predicted polypeptide sequence is orthologous to G478
atattccagagggtccttaaatgaagctcgctcccgtaagtgtagggaattttacgagttgaaccaactccctccctgggaatcccaaatcccccactgcttcttctatgtgtttaagcttgtaagatcatcaatggtaagcaatcatacagacaagaaaaacgacaccgtagcctcgccggaaacaagggggaaaagggtttttctttgaaattttgctgcttccacaccatgttggaatacgaatggggaaacccctcttcaatcatgttatcgggtgaagagaccgcccaagaacccgaccccaatcgtcagcttttccatcactatgccaccaccaccaccaccaccaccacccaccaccaaccttacaacgaaaccctcctttctcatcacaaccccactgttttttctcaccaaaacctcttccataaccctaaccaagctcaacccccccaacaccctgctactcttcattccttgtacgacccgcactcctactctgccacctccgcttactccactgtccacgcttccttgctctcactggacccagtttctgccgtcggagggagcggaggcggttactttctcgttcccaagacggaggaagtttctagacctgttgactttactgccaggattggtctcaacttaggtgggcgtacgtatttttcctccgccgaggatgactttgtaaaccggctttatcgcaggtctagacccggagatctcagctcaaccaattcccccaggtgccaagccgagggttgcaatgccgatcttacccaggctaagcactaccatcgccgccataaagtctgcgagttccattccaaagcttccaccgtcatcgccgct

SEQ ID NO: 16088 - DNA, 865 bp, Gossypium raimondii
  Predicted polypeptide sequence is orthologous to G502, G519
cgcgtagaataccaaagaagtttgtagcaattaacaccgagagcgagtgtgaaaaagctcaaaaactacgtttattaccttcaaggtgaaaagttcaaaaaatgacagcatcggagttacagctgccacctggattccgattccatccaaccgacgaagagcttgtgatgcactatctttgccggaaatgtgcatcgcagtccatcgccgtgccgattatcgctgaaatcgatctttacaaatacgatccttgggaccttccagatttggcgttgtacggagagaaagaatggtattttttctccccgagggataggaaatatccgaacggttcacggcctaaccgggcagctggttctgggtactggaaggcaaccggagctgacaaaccgattgggcagccgaagccggtcgggattaagaaggctttggtgttttacgctgggaaggcacctaaaggagagaaaaccaattggattatgcacgagtatcggttagctgacgtggaccgatcggctcgcaagaagaacagtttaaggttggacgattgggtgctttgccggatttataacaagaaaggcgccatcgagaaacagccaccgcaaggaagcattggcaaaagctctgccgtgacggagatcgaagacaagaagccggatatagcgacacttggcgtggacacgcgccagctgcccccgcctcctacggggctagttaacgattacgtgtactttgacacgtcggagtcggtgccgagactccacacggactcaagctgttcggagcacgtggtgtcaccggagttcacgtgcgaggttcaaagcgagccgcaatggaaggactgggggaagtgccaccaacacca

SEQ ID NO: 16089 - DNA, 636 bp, Gossypium raimondii
  Predicted polypeptide sequence is orthologous to G504, G1425
ttaggctcaatactcttcaactcctccctttaatgagaactgggaatataacattgaaccaaagctgaccagcaaaataatggagagcacagattcgtcgtcggcgtccgcgcacccgcaactcccaccggggttccgattccgcccgaccgacgaagagctggttgttcactacctcaaaaagaaggccgcctctgctcctctgcctgttacaatcatagctgaagttgatctttacaagtttgatccatgggagctgccaagtaaggcaactttcggggagcaagagtggtatttttttagtcctagagacaggaaatatccgaatggagcgaggcctaatagagctgcaacttctggttattggaaagccactgggaccgataagccgattgtaacttcaaatggaaatcaaaaggttggggttaaaaaggctctagtgttctatagaggtaagcctcccaaagggattaaaacgaattggatcatgcatgaatatcgcctcatcgacaacaattccacttccaaacctcaaattgttgatcttcccaacaggaaagcttctttacggcttgatgattgggtcttatgccggatttacaagaagaacaatacccagagacctatggagacaga

SEQ ID NO: 16090 - DNA, 862 bp, Gossypium raimondii
  Predicted polypeptide sequence is orthologous to G504, G1425
gatcaaaccataaaagtcctatgatgctctccttctctggtaaactttcagaattcaaagtaaaatattctccatttcattactgagttatatatacatacatatatatatttgaaggtgtcgcaatggagagcaccgactcgtcgaccggatcacagcagccgaacctcccaccgggattccggttccaccccactgatgaggaactagtggtacactacctcaagaaaaaagctagctccgctcctttgccggttgcaattattgctgaggttgatttgtacaagtttgatccatgggaattgccagcgaaggcaacgtttggtgaacaagaatggtacttttttagtccgagagacaggaagtatccgaatggagcgagaccgaacagggcggctacctcgggttactggaaggcaaccgggacggataagccggtgttgacttcgggagggactcaaaaggttggtgtgaagaaggcactggttttttatggagggaagccccctaaagggatcaaaaccaattggatcatgcatgaatataggcttgctgataataagactaacaacaaaccccctggatgtgacttgggcaacaagaaaaactcactaaggcttgatgattgggtgttatgtcgaatctacaagaaaaacaacgcgaatagacctctggaacatgataaagatgactccatggatgacatgcttggtactgtaccgccttcaatatcaatcggtagccaacataatccaaaattccacttctcaacaaagggaacaagttttggcacattactagaacatcaagaacataatagtttgtttgatggaatgatggggagtgatgggattaacagtgc

SEQ ID NO: 16091 - DNA, 849 bp, Gossypium raimondii
  Predicted polypeptide sequence is orthologous to G536
actccctcccgaaatctcagatctaatattcttttaacctaccatctctttcgctatctgccttttcccttcctctctatctgattcctatcgacaatggccgccgccgccacttcttcaccccgcgaggaaaatgtctacatggcgcaactcgccgagcaagccgaacgctacgaggaaatggttgagttcatggagaaagtctctgcctccgccgacaacgaggagctcaccgtcgaggaaaggaacctcctctccgtcgcttacaagaatgttatcggtgctcgccgtgcttcctggcgcatcatctcctccattgagcagaaagaggagagccgtggtaacgatgaccacgtcgctacgatccgtgattaccgggccaagatcgagtccgagcttacttcgatctgtaacgggatcttgaagctccttgacactaggcttgtcccctcggcttcctctggatattccaaggtcttctatcttaagatgaagggagattaccacaggtacttggccgagttcaagactggagctgaacggaaggaagctgctgagagtactctcactgcctacaaatctgctcaggacattgccaacgccgagttggctcctactcacccgattcgacttggactggcactcaatttctctgttttctactatgagattctcaattctcccgatcgcgcttgcaatctcgccaaacaggcatttgatgaagcgatagctgagttggatactctaggcgaggaatcgtacaaagacagcaccctcatcatgcaactcctccgtgacaatctcactctctggacctccgatatgcaggatgacggggctgatgatatt

SEQ ID NO: 16092 - DNA, 931 bp, Gossypium raimondii
  Predicted polypeptide sequence is orthologous to G536
gatggccactccttccccacgcgaagaaaatgtctacatggccaaactcgccgagcaagccgagcgctacgaggagatggtcaagttcatggagaacgtcgtctccgccgtccccgctcccgacgaactctccgtcgaggaacgtaacctcctctctgtcgcctacaagaacgtcatcggcgcccgccgtgcttcctggaggatcgtctcctccatcgagcagaaggaggaaggccgtggcaacgccgaccacgtcgccgtcatccgtgactacagggccaagatcgaggccgagttgtccgagatttgcgctggaattttgaagctccttgacgagaagcttgttccggctgctggaaatggggattccaaggtgttttatctgaaaatgaagggagattaccataggtacttggctgagttcaagactggcgatgacaggaaatctgctgccgagaataccctcactgcctataaatctgctcaggacattgcagtagctgagctagccccaactcatcctatccgtttaggattggctctgaacttttctgtcttctactatgagatcttgaactctcctgatcgtgcttgcagtcttgcgaaacaggcctttgatgaagccattgcagagctggatactcttggagaggattcatacaaggatagcactttgataatgcaacttctccgtgataacctcactttgtggacctcagacatgcaggatgatgggactgatgagatcaaagaagcttccaagcctgaggaagagaaacaaccgtgaagttcccagtctttgtggtagcattttacttctcttcttgtttttgtatggagaagttggttgatcccactctctctttagttacttgcttttagttgatcaggcctggatttatgaaccttggaagtaactgctataaattcc

SEQ ID NO: 16093 - DNA, 878 bp, Gossypium raimondii
  Predicted polypeptide sequence is orthologous to G536
ctcaaatccctctgaaaaatcctctcacattttctttccatcccaacatcccccaaaatcaccatggcctctacttcaccacgtgaggaaaatgtctacaaggcgaaactcgccgagcaagccgagcgctacgaggagatggttaagttcatggaaaccgtcgtttcctccgtcgttgctcccgacgaactcaccgtcgaggaacggaatctcctctccgttgcctacaagaacgtgatcggcgcccgccgtgcttcctggaggattgtttcttccatcgagcagaaagaggaaggacgtggcaacgccgatcacgtctccatcattcgtgagtacagggccaagatcgaggctgagttgtctgagatttgtgccggaattttgaagcttctcgaagagaagctcgttccggctgccgggaacggggattccaaggtcttttatctgaagatgaagggagattaccataggtacttggctgagttcaagactggtgatgaccggaaagccgctgctgagaatacgctctctgcgtataaatctgctcaggacattgcagtttccgagctcgctccaactcatcctattcgtttgggattagctctgaacttttctgtcttctactatgagatcttgaattctccggaccgcgcttgcagtcttgcaaaacaggcttttgacgaagccatctcggagcttgatactctcggagaggattcatacaaagacagcactctgataatgcaacttcttcgtgataaccttactttgtggacctcggatatgcaggaggatggaaccgatgaaatcaaagaagcctccaaacctgaggatgagaaacaacagtaaaatccctaatcttcgagttagtattttac

SEQ ID NO: 16094 - DNA, 783 bp, Gossypium raimondii
  misc_feature (11)..(11): n is a, c, g, or t
  Predicted polypeptide sequence is orthologous to G536
ggaagctcacncaatttctgcaaaaatcgttacgatggtgcctgacaatctaagccgtgaccagtacgtttacttagccaagttagcggaacaagccgaacgctacgaggagatggttcaattcatgcaaaagctcgtcctcggctctactcctgcctccgagctcaccgtcgaggaacggaaccttctctcggtcgcttacaaaaacgtgatcggatctctacgcgccgcgtggaggatcgtttcttccatcgagcagaaagaagaaggtcggaagaacgaggaacatgtggtgctcgtcaaggagtatagatcgaaggttgaatctgagttgtcggatgtttgcgctagtatcttgactttgttggactcgaatctgatcccatctgctgctgcgagtgaatcgaaggttttctatttgaagatgaaaggggattatcatcggtatttagcagagtttaaggttggtgatgagaggaaagctgctgctgaggatactatgctgtcttacaaggctgctcaggatatcgcactgacggatctagcaccaacgcacccgatcaggctgggacttgcgctgaattactcggtgttttactatgagattctgaatcagtccgataaggcttgtagcatggctaaacaggcatttgaggaagccattgctgagcttgacacgctgggagaagagtcttacaaggacagcactctcattatgcaactcctaagggataaccttactctctggacttcggatgttcaggaccagttagacgagccata

SEQ ID NO: 16095 - DNA, 745 bp, Gossypium raimondii
  Predicted polypeptide sequence is orthologous to G536
aagacaacaaaaaattgaacataaggaagtaagtcataaagactataaagtaaccgattcaataatgtttaaacagaagagaacacagaacaacagtctgaaaacatctgataaacaaatcgaaccatgtcataggtaacaaatcctggtactactaccatgagttgaaagcaggtcactctagcagcaagcccctttcctacctcgacaagcccagtcttaaaagaatactctttcatccaattaactctcagcctgaggttcatctgcttttgattgctcacctccttcctctggcagatccgaggtccacaaggggaggttgtccctaaaaagctgcatgataagggtgctatccttgtaagattcttcattaaggctatcaagctcggcaatagcctcatcaaatgcttgtttagccagatgacaagccctctcgggagaatttaatatctcatagtaaaaaactgagaagttcaaagccaggccaagtctaattgggtgagttggaggcaaatctgagcttgcagtggaagtggcagcctcataagccttaagtgactgatcagcagcttctttacgatcatctcctgccttaaattctgccaaataacgaaaataatctcctttcatcttatagtagaaaacagttgattccccggtggaggaagatggaatgaggtgcttgtcaatgactgagagtatgtcattgcatatttttgagagctcatcttcaaccctttgc

SEQ ID NO: 16096 - DNA, 770 bp, Gossypium raimondii
  Predicted polypeptide sequence is orthologous to G558, G578, G629, G1198, G1806
ggagaatccaatccggctgatggtagtccaaagactgacatctctacagatgcagacactgatgaaaaaagtcagaggtttgatagaggaaaatctagtattgttgcggtttctgattctagtgacagatcaaagagtaatttggatcaaaagacacttcgtagactagctcaaaatcgtgaagctgcaagaaaaagcagattgagaaagaaagcatatgtgcaacaactagagagtagtcgtttaaagttgacacaattggagcaggagcttcagcgggcacggcagcagggtatcttcatatcaagctctggagatcaaagccattcgatgggtggaaacggtgccatggcatttgatgtagaatatgcacgatggttggaagagcaaaaccgacaaattaatgagctgagaacggcagttgaagagcaatgcagctaaggctgatgttttccatttgttgtcaggcatgtggaaaacacctgccgagaggtgtttcttatggcttggtggtttccgttcatctgagcttctaaagcttcttgtaaatcaattggagcctttgaccgagcaacagttggtggggataggtaacttgcagcaatcctcccaacaggctgaagacgcattatcccaagggatggaggcattgcagcaatctctggctgaaacattgtcgactggatctttaagctcttctggatcatctgggaatgtggcgaactacatgggtcaaatggccatggccatgggggagctcgggactcttg

SEQ ID NO: 16097 - DNA, 846 bp, Gossypium raimondii
  Predicted polypeptide sequence is orthologous to G558, G578, G629, G1198, G1806
cgggagaattggggagattccaatatggcagatggcagccctaggactgatacgtcaacagacgacactgaagagaagaatcaaaggtttggaagaggtcaaacaaatgctatcgtggcttccgattctagtgacagatcaaaagataaaacagaccagaagacattgcgtaggctagctcaaaatcgggaggctgcaagaaaaagccggttaaggaagaaggcgtatgtgcaacagctagagagtagccgactgaaactgactcaactcgagcaggaactgcagcgagctcgtcagcagggtatattcatttcaagcacgggagatcaatctcattcgatgagtggaaatggtgccttggcatttgacgttgaatattcacggtggctagaggagcacaataagcatataaatgagttgagggctgcagtcaattcacatgctggtgacgccgaacttcgcactattgtcgacagcgtcacagctcattttgatgacattttccgtttgaaaggtattgctgcaaaagctgatgttttccatatcttatcgggaatgtggaaaacaccagcagagcggtgttttctgtggataggtggcttccgttcatccgagctccttaagcttcttgcaagtcagttggagcctctaactgagcaacagtttatgggtatccaaaacttgcagcaatcatcccagcaggccgaagatgctttgtcacaagggatggaagcattacaacaatctttggccgagacattggccaatggctcacctgctccctcgggaccatctgggaatgtggcaaattatatgggccaaatggctatggccatggggaagcta

SEQ ID NO: 16098 - DNA, 466 bp, Gossypium raimondii
  Predicted polypeptide sequence is orthologous to G565
cccactctcattagaagaatttaattcaaatgattagtacctttccatgtcaataaggtcagtctatgaacaatccaacacagaagaacttgtaatcatactgttccactgctttcagcggcacaaattgaggggctttcagatttcacaaagggcgagcccctgctactggtatcaagcccttgcaataggccaagaggatcttgttgcatcatgtcggccaaggcatgcgagttggtattcaaggaagatgtcaataagtcagaacccgaaaggagaggaagtgagtggtgggtcggggataggggagaagtataaaggaggagggaaaggaaggcataggtattttttttttcgggcgatggatgctccatagcggagaccattgaagctaataaagccatggctcctgataaacttgctgaattgtggacaattgacccggaatagagctaaaaggatcatt

SEQ ID NO: 16099 - DNA, 881 bp, Gossypium raimondii
  Predicted polypeptide sequence is orthologous to G565
cttggatctcgtgtccgatcccttcgaaccgttatgatccgaagacgacatgctttgtagttacatggaccttgagatgccaggggaatcagcgaagggagtcgaggcggctgctgggtcttggagtcagaacccgaaaggagaggaagtgagtggtgggtcggggataggggagaagtataatggaggagggaaaggaaggcataggtatagcaattcggttgatggatgctccataatggagtccattgaagctaagaaagccatggctcctgataaacttgctgaattgtggacaattgacccaaagagagctaaaaggatcattgcaaatcggcggtcggctacacgctcaaaagagaagaaagccctatatatgtctgaattggagaggaaagtccaaacacttcaaacggaagcaacgactctttctgcacacctaaccctattccagagagatacgacaggcttgactactgagaacgctgagcttaagctccggctacaagcaatggaacaacaggcgcagctatctgatgctctaaatgaagcattaaagaaagaagtagagaggctcaagactgctactggagaaataacgacgccgactgataccttcaatttaggaatgcaccatatatcatacgcccaatcttccttctttcctcctcagaatacacaactgccaccatttcatcctttccattctaacttattgacatcttccttgaataccaactcgcatgccttggccgacatgatgcaacaagatcctcttggcctattgcaagggcttgataccagtagcaggggctcgccctttgtgaaatctgaaagcccctcaatttgtgccgctgaaagcagtggaacagtatgattac

SEQ ID NO: 16100 - DNA, 892 bp, Gossypium raimondii
  misc_feature (879)..(879): n is a, c, g, or t
  Predicted polypeptide sequence is orthologous to G584, G1136
cgtttacttcaggtgtaattttaccttcatctggtgtggtgaaatcaagtgggggtgccggggattcagatcactctgatcttgaagcttccgttgttaaggaggccgatagtagtcgagtcgtagagcctgaaaagaggcctcgaaaacgggggagaaaaccggctaacggaagagaagagcctctaaatcatgttgaagcagagcgtcaaagaagggagaagcttaaccagaagttctacgccctgcgtgcggtggttcctaacgtgtcgaagatggataaagcatcgctcttgggtgatgctatttcatatattaacgagctcaagtcgaagctacaaagtgcagattcggagaaagaggagatgcagagccaattagaggcattgaagaaaaatttgtcaagtaaagctccaccaccacatgatcaagacctcaagatttcaaatcacactggcgataaattgatagatttggagattgaggtgaagattattggatgggatgcaatgattcaaatccaatgcagtaaaaagaaccatccagcagcaaagctaatggctgccttgaaggaattagacctggatgtgcaccacgctagtgtatcagtagtgaaagacttgatgatccaacaagccaatgtgaagatggggagccggtttttcacgcaggagcaattaaaatcagccctaacaaccaaacttggagatgcaagatagagagtattgagcagagcttgattgaaagatcattgttgaaaatggctgcagggttctgggatattttaaggctcctggtagcacgagctctgtaaaataatgttctattttggtcttattagtgtttagtgtagttaataatagtttgagaggtgatgtntatgaatctggag

SEQ ID NO: 16101 - DNA, 811 bp, Gossypium raimondii
  Predicted polypeptide sequence is orthologous to G597
tttttttccctttatagtttaatttcaacatgagcatcatcatcttcatcactatcacccttccactaacgtaactgtaattggcaacaaactcaaactcggcatcttcagtctgaaacacaacacctaaaagactagaacacaagtgctttctctctcgcgtctgacttacacctttaccttacaaatgcatcacactaacaacactcctaagccaagacctatcgggcgtttctagcttagcaaccaagtcccaagttcaacaaaaaaagtaaatcctgtacccttaattctacttcagttacacgatgcttaaattacaaaatggttcccactacaacactggctgacccactacagactacccagttaaaagcatgattttacttccatggaaagtttgacatgccttgtgggttattattgttgttattattgcaggttcccatgctctggttaaccgggctaccaggcccacctgaggattcacttagagtaccatgtgaaggtgagctggtaacccctggagcaacctttggtggggcagataggccttccatctggtatgttgactttgcttcctttcgattgtctgtaataaaactacccacaaccacctgaacaggagatgcagctgttagaaggccagctacaccaccacctaaaacacgaccatctgggccagacaatgacacacttaaccctccagttctgctccgctgaccaccattttctgacagaagaaatgaaccagatagtgacagaatttcaaatcgcccctcataagttacagttccaccagatgttgctg

SEQ ID NO: 16102 - DNA, 710 bp, Gossypium raimondii
  Predicted polypeptide sequence is orthologous to G602
ccattaccaaattattatcatttttctttcccttttcacaaattgtacacctataagctttaattatggcggaggaaacgaagaaggaggttgcggctgaaacgcctgtggctccgacgccggcagtggaagctccaacgccggtagcggaggatcttaaagctgattccaagaaaacaaccgtagctccaccgccagctgaggaaaaatccgatgaatcgaaggctcttgccgtcgttgagaaagcccctgagccagcaccaaagaaaagttcaactggatcacatgatagagatgttgctcttgcggatcttgaaaaagaaaaaaagttgtcattcattaaggcatgggaagatagtgaaaaaaccaaagctgagaacaaggcccagaaaaagctctctgctattgtagcatgggagaacagcaagaaagcagctcttgaagcaaaactcaaaaaaattgaggaacaattggaaaagaagaaagccgagtacgccgagacaatgaagaacaaggtagcttcaattcacaaggaagcagaagaaaagagagcaatggtcgaagccaaacgtggagaagaggttctcaaggccgaagaaatggctgctaaataccgtgcgaccggacaaagtccgaaaaagctccttgggtgtttctgaaaatttctggtccggttttgaaatgaatttcattaaaacttgtttgcttgc

SEQ ID NO: 16103 - DNA, 895 bp, Gossypium raimondii
  misc_feature (890)..(890): n is a, c, g, or t
  Predicted polypeptide sequence is orthologous to G616
tttctcaaactcctcctttactgagttgcttactagtggtattggaaatgttagcaacaataatactagtccttcagcatcagcttcagcttcagcacatcaagaccctagtgcggagtctgatttttaccaaaaggctaatagtactgctaggctctggccagtgactccaatggattactttgcctcggggctacttggaccatcttcttcaagaggtcatcattcttcagggtttcctggaggacaaatccatctagtgaactctttgcaacaaccaatgacaacaccaccattcaccgtgtcaggtgagaaccatcaagagatgcagcatttctcgtttgttccaaaccctgaccatctcatcccggtggcaacaacacaaccggggcaaggggttgactacaacctcaatttcacaatctcttccggccttgctggtttcaatagggggacccttcagtccaattctccttttttgcctcctcacctccagaggttttcttctatagatggatcatcacccttatacattggtacaccaccagtggagaatcatcaccaccatcaattcacggctggattagatggccgcttgcagctctgctatggggatggaaacaggagctcagaccagaaaggaaaaggcaagaactaatcagtttcctttaaaaatggtttccacctggctccatcttttccctggaaagcagagatggagagagctgcagtgggaaagcattgagtgaatgtgcatgcatttgggtgattatttgatatacctttatttctgtgcttctgaaaattgttggtattttctgttttatccttttctgaagtcaaatcattatgtgttttcaacatgtataacaaaacaattcaattcaagntattc

SEQ ID NO: 16104 - DNA, 866 bp, Gossypium raimondii
  Predicted polypeptide sequence is orthologous to G616
gattcagacacacaaggttctaagttctcatgagttggtaatgggagaagtgagtcgagcaggatgggtcagaaaggtagtgacaactactaccctgatgatgaagaaggtagagaggtcatgaaaagggctagtgcaaatggaggtggaggtgatgctctagctgacaccgctgctgctaatcggcttcgaggctggcaccattcttcgagaattattagggtttctcgagcctcgggtgggaaagatcggcacagcaaggtttggacttcaaaagggttgagggataggagggtaaggttatctgtcaccacagctatacagttttatgatctacaagaccggttgggctatgatcagcctagtaaagcaatagagtggctgattaaagcagctgctgatgcaattgcggagcttccttcacttaacacttcatttcctgataccccaaggcaattgagtgatgatggaactgaacaagggtttgactcggctgaagtagagttagatggcgatccgaataattaccaagaaaaccaaagtcagcagcacctttccttgtccaaatcagcttgcagtagcacgtccgagattagcaagaactcgggtttatccctttccaggtctgagaaccgtgtaaaagcccgggaacgggcaaggggaagagtagcaaaagaaaaggggaaagagcaaaagactgacattgcacatcaacaaaatgtgaaccccatttctcacaactcttccttcactgagttactaacctgtggcattggcagtgttagcaacaatcacactagtcctagtcctaccgcttcagctcgtcaaaccccaggcagtggcctgtcactcaaatggattacttt

SEQ ID NO: 16105 - DNA, 755 bp, Gossypium raimondii
  Predicted polypeptide sequence is orthologous to G618, G2057
agggaacagtagcatcaacataaacattgcaaacaaatgtccagtaacataaaaaacacatgacaagttctgcaagaagagaagccatagctgagttttaagagctcagtcaaaaaaatagtcaaagtacaacacaatgaactgatagaaactaatggaaccggggattgaataacctgaaatcaacccagatttcttcttcccacggcataggccattgatttgaagtgaccaaaatcttccctcaaactggtgttgaatcgagcagcatctcctcatttacttcactgtcaacgatcaaactggtcctgttagaggggaaagactatggcttttctccattttattggatcaatggtgagagtcagaggaagcagaggacagcttatttgcgatgctgtcttgatcctcttgtgcgccctggaaccgtgctggaacgcgaaatccagagaatacacctgatgtggtgaattcaatgccagataaagcaggttggtgatggatattttgtgggatttgatgatgatgatgatggtattcgtcggttgttggaattggctggtctatccaagcacgaaccaagggcgtgttactggactgaaggggtcccctctgaaagaaaaactggccgttttggccaaaagctggtgatagtggcggtgctgatagattgccaaagagaaatcctcccattccaccgccaccgccactaccagtatcagcagcagcagcaccattattccaggccaccaatc

SEQ ID NO: 16106 - DNA, 903 bp, Gossypium raimondii
  Predicted polypeptide sequence is orthologous to G618, G2057
gttcgtctctcggctccaccgccatccagttctacgacgtacaggaccgtctcggatacgaccgtcctagcaaagctgtggattggctaataaaaaaagccaaatccgccattgacgagctcgccgagcttcctccatggaacccattggatgcaacgatttcaaccaagaaacccaataaccaagaagacctaaacacatcaacagcaacaaacaatgaatttcacatcgaaaaccttgctgctgggtctggttctcaatgcgttcagcagcacgaaatgggagataacttgaataataattcgggttttcttccagcttctttagtttctgatgagattgctgatactatgaagtctttttttccattgggagcttctagtgagacgccgccgtcttcttcattacaatttcaggattacccgccggacttgttgtcaaggacgagcagccatagtcaagatctgcggctttcgcttcagtcatttccggagccaattcttttgcatcaccatgaacaccatgctgctgctacagctcaggcgcaccatagtgaatctgttctattctctggaaccaccccattagccggtttcgatgggtctaatgctggatgggagcaccaccagcagcagcaaccggtggagattgggaggtttcagagattgtttgcttggaatagcagtggtggtgatgctggtggtggcaatggcggtggatttatctttggcactccatcgcaacagtcattgccactgacttttggccaaaacagccagtttttttctcagaggggaccccttcagtccagtaacacacccttggttcgtgcttggatagaccagccaattgatgaacaccatcatcatcatcaaatcccacaaaacatccatcaacaagctg

SEQ ID NO: 16107 - DNA, 839 bp, Gossypium raimondii
  Predicted polypeptide sequence is orthologous to G618, G2057
cagcattagaacaaactaggttcccatctcagtagtaactctaggaaacagtagcaaacattgattggtaacatgaaaaacatgacaagtccaacaagaaaaagaaaccattgttaagctctaagagctcactcaaatataaatttaagctacaacacaatcaactgatagaaactaaacaaaccggggattgaaaaacctgaaatccacccagatttcttcttcccacggtataggccattgattcaaagttgaccaaaatcttccctcgaactagtctttgattcttggatccatcatagtatagttatcttctcatccagttcacagtcaacaatcaactagtgctgatagaggggaaagactttggccttttctccgatttactcgatcaatggtgagaatcagatgaagcagaggacagcttattggcaatgctgtcgtgctcatcttcttcgccctgaattcgtgctggaacgcgaaacccagagaatacaccaggcgtggtgaatccaatgccagataaagcagtgtgatgatggatgttttctgggatttgatggtggtgatgttgttgatgatgatggtgttggtgttggtcggttgtggaaattggctggtctatccaagcacgaaccaagggcgtgttactggactgaaggggtcccctctgagaaaacaattggctgttttggccaaaagccggcggcagtgactgcggtggaggagtgccaaagataaatcctcctcctacaccgctactggccgcagcaccaccgccaccgctactatcagcagcagcaccgctattattcaggcaaacaatctctggaaccttc

SEQ ID NO: 16108 - DNA, 853 bp, Gossypium raimondii
  Predicted polypeptide sequence is orthologous to G653
ctcctctctctctctctctctctattttgtttgataaatacccagaaaaccctttcagtcttctagctctcaatttctttttcttttttaccttcttatttcatagatccagggtgctcttcttcttagttcacattggcatagataaaggactgtacggtcagatctaagccgtattctagcaatgtcgtttaccggtactcagcagaaatgcaaggcttgtgagaagactgtttatccggtcgaacttttgtcggctgatgggatcccttaccataagtcttgcttcaaatgcagtcattgcaaagggacactaaagttgggtaattactcctcgatggaaggtgtcgtttattgcaagcctcatttcgagcaactgttcaaggagtcggggaatttcaacaagaatttccagtcacgtatgtatttttttttcctctcggtggatggaatcctttatttggtttcttgatagttttcgtgtttcgttggtttttaatttgccttcggttttgttttcggcagctgcaaggtcagctgagaagttaactcctgagctggtaaaatctcccttgcaaacaccggatgtgtttgatgtttcgattaattgggaaaaattcgttatagtgtgtcataatgtttttgctaactcctaatagctcgtgttaatttcagacaagatcacctagcaaagccgccagcatgttttccgggacacaagaaaaatgtgctacttgtggcaaaactgcttatccactcgagaaggtagcttttgagatccattaaatcattagatgagaaatctatatattttctgcaattgccggactccaattttctggttatctatatg

SEQ ID NO: 16109 - DNA, 883 bp, Gossypium raimondii
  Predicted polypeptide sequence is orthologous to G715, G1646
tttttatttttattttggaaaataataatcatataacaaagccagcgcaaaatgcaatggccgctgtaccttatcccatccatatctgacccttaaaaatatccaccgccgccaccaccaccacgatcaccaccgccacatccccatctcccgccatttggtcaccagccaatggacagtaaccagcaaactcaatccaccccatacccacctcagcctcccacatccgccattacccctccttcatccgccacagcaaccgcgcctcctttccaccacctccttcaacaacaacagcaacagctccaaatgttttggtcataccaacgccaagaaatcgagcaagttaacgattttaagaaccaccaactcccattagctcgcattaagaagataatgaaagccgacgaagacgtccgtatgatctccgccgaggctcccattctcttcgccaaagcttgtgagcttttcattttggaactcactatccgttcttggcttcacgccgaggaaaacaagcgacggacacttcagaaaaacgacatcgctgcggctattacgaggaccgacattttcgatttcttggtagatattgtgcctagggatgagatcaaggatgaaactggtttggctccgatggttggggctaccgccagtggggtaccttacttttatccccctatgggtcaacctgctgctggtggtcctggtgggatgatgattggccggcctgccgtcgatcccaccggaggtatttacggtcagccaccttctcaggcttggcagagtgtttggcagacggcgggaactgatgatggctcgtatggaagtggagttaccggtggtcaagggaatcttgacggtcaaggctaacctaaaatca

SEQ ID NO: 16110 - DNA, 843 bp, Gossypium raimondii
  Predicted polypeptide sequence is orthologous to G715, G1646
catctgccgttgattcttcatccaatcgcttgaggacaagcaagcccagtcctcctcttaccctcctcctcctcccactacttctattacgcctcctcctccttcctcctccgccgccatcgccgccactccgcctgctcctttccaccacctcctccagcagcagcagcaacagctccaaatgttctggtcttaccagcgccaagaaatcgagcaagtcaacgacttcaagaaccatcagcttcctcttgctcgcatcaaaaagatcatgaaagccgacgaagatgtccgtatgatctccgctgaagcccctattctcttcgccaaagcctgcgagcttttcattctggagcttaccatccgttcctggcttcacgccgaggagaacaagcgacggacgcttcagaaaaacgacatcgcggcggctattactaggaccgacattttcgatttcttggtggatattgtgcccagggacgagatcaaggatgaggccgttctgggtgggatggtgggtaccaccgccagtggggtgccatatttttatcctcccatgggtcagcctgctggcgctcctgctggacctggcgggatgatgattggaaggcccgccgtcgatacaaccggtggtatttatgctcagcctccttctcaggcttggcagagtgtttggcagacggcgggggctgacgatgggtcgtatgccagtggaggtagcggcggtcaggggaatcttgacggacaaggctaagcaattcattgggtcaatttgggtgctcgatggcatggcaaatggcgtgatgcactggggtattgcactaagaaatttgggttgcttatgat

SEQ ID NO: 16111 - DNA, 680 bp, Gossypium raimondii
  Predicted polypeptide sequence is orthologous to G718
gattggactctgatgctgttggatgtctatgatctggtgacaggttgcttctgttttatatgaagactgtgcttagtgttctatgagttctatctctccgatggattggaatgccaaaacgcctttgcaatgggactgggaaaacttgatgatgttaaatgcaacacccgctgaaattccaaggaagctcagacctgaagagtgggatattgatggagagggaggaatgaactcagggtctttctattcttctggtgctgctggaggtagtggtggttctggctcagatttgggccttgcttctttgtctaaaagttcaaaatcggcatctattaattcttcttctatgggggaggtaaaaatgaccaaatttacttcggaagcctttgaagctatcccagatgatattagcaaccagaacgaagctttcagggctgagctggctggtacttccccaacacttgaggcttcagttggctctggtgagccattgctcagtttaaagcttggtaaacagacatactttgaggatgtttctggaggaagcaatactaagaatttgtcttattcttccacttctggacaatctcctgcccaagcaaagagatctaaacccaattgtcagggcatacatgttccgcgttgccaagttgaagactgtaactttgacctctcctcag

SEQ ID NO: 16112 - DNA, 568 bp, Gossypium raimondii
  Predicted polypeptide sequence is orthologous to G718
aattgcaagaacatcaatgcctcatctttattgccttaatcaaagtctagctcctcaaataatacgcttttgcaaacattgtgccaaataccatgcttcttgttgtttgactaaccatgcaaggaagaaaagccaacaggtgaaggtcaaagaaatattgaagagatgctctagcaatgatgggttaaagaaagttgaacccaagtacaagtccttaaagcccaacaatggaaaaagggggcttgggttcaactcagttaaagaaaaccctagcatagtgcataaggggtggagatcccccaagttcatagagggaaccaccctatatgatgccttggggaggattcactcctcaaatgacaagtcaactcaagtaaaggtaaacttgagttccgcaaagagtaagatgaaggaagctggatcaacaagtggagaaaaatttaatgctcccatttctcactcttatctttgtgattatatgttgacgtgggatttagggaaattggctgttaaatatgtgggtgccctaccctaaaagaaaagtcatgaaaagaactgtgtgggtacc

SEQ ID NO: 16113 - DNA, 833 bp, Gossypium raimondii
  misc_feature (807)..(807): n is a, c, g, or t
  Predicted polypeptide sequence is orthologous to G735
cacataatggatagagttttctccgtcgaagaaatctccgaccacttctggccgtcctcctcctcctccgccaccaccaactccgcttccgctgatgacgataacaagtccggttctaaaatgaaccgtagtgcttccgaatgggcttttcagcagtttattagagaggaagttgataaggaaggtgaagatgaaggagtgactgagggggatctaaagaagaagaatggaacggcgtcgtttaacaatgggtgtttagagagtaatggtaataacaatgttctggtagattcagatgaataccaagcttttcttaagaacaagcttaacttggcttgtgctgctgttgccatgtcaagggcatcttttgtaaaaccgcaagattcggctgttagagctgacagcggatcacaggcatccgatactccccagtcagtatccatagctacttctaaaggggctggtgataagaacggtaatgcactgtcgggatttccttcagtggttaatggacaaaagaagattggagctcaggtgaggccaagcacaagtggatcatcgagagagatgtcggaagatgatgaagtagaaggagagaacgaaacaatggagaacatggatccagctgatgcaaaacgtgtaaggaggatgctttccaatagagagtccgctaggcgctctagaagaagaaagcaggctcatttgaccgaactcgagacacaggtttctcaactaagagtcgaaaatgcaaccttattgaagcgtcttactgacattagccaaaagtacaatgaatcagccgtcgancatagagttctgaaagctgatgttga

SEQ ID NO: 16114 - DNA, 760 bp, Gossypium raimondii
  Predicted polypeptide sequence is orthologous to G773, G1412
aaagcttattaaatttcaatggattttcatttattacatttcaaaaataacagcaataggttagcccaaagaaatccaaacaattatacaaagttttgaaatcctcttcaattccatacctctttccccctctctctcttttttttttcaactttttattgcttaaacacaaacccacccgactgagtcaggtaccggaatccatacgggtcaattgagttagaaaagttctgggtcatcaacccactagagttctgttgaaaaaaccctgagttattaattcgctgagttctgagtccactctgtacttcctcttccaccgaattaccagctttactcattgacatatccatctgggttagcgtaggcggcatcgtgggtatacacaggtcattatttacataactttgaatcccctgagtctgagtttgtccactgggaaccaactcaggcaccgagttaagccctgcaagactcgcccaatctaaattcccactgcccagattgtgaaaccccgttttgtcatcgttttgaagcgtcttcaacgagttcatccgaggcaaagcaaaataacgattgtctaactcggggaatggctcaagcatatcgtcgagttgggaagaagaagaagaagtagagccattgttactatgctctttgcttgaaacacatggtaatgatttttgagcacttgaattcttcttgtaaattctacataatacccaatcatccaacttggagctaccacttttacgggaag

SEQ ID NO: 16115 - DNA, 873 bp, Gossypium raimondii
  Predicted polypeptide sequence is orthologous to G773, G1412
aactttttggtcggcaagaaaactttacaatcatgggagtgccggaaactgatccattggctcaattgagcttgccgccggggtttcggttttatccaactgatgaagagcttttagtgcaatatttatgcaggaaagttgcagggcatcatttttctctgcaaatcattggcgaaatcgatttatacaaatttaatccatgggatttaccgagtaaagctttgtttggtgaaaaagaatggtattttttcagtcctagagacagaaaatatccgaacgggtcacgacctaatagagttgcagggtccgggtactggaaagctaccggaactgataaaattattacaacggaaggccgtaaagtgggtataaaaaaagctctggttttttacgtcggaaaagctcccaaaggaactaaaactaattggattatgcatgaatatcgactcattgaaacttctcgtaaaagtggtagctccaagttggatgattgggttttatgtcgaatatacaagaagaattcaagtggtcaaaaacctttgtcaagtgtttcaagcagagagcaaagcacgaatgggtcatcatcatcgtcttcttcacaactggatgacatgcttgagtcattgcccgagttggacgatcgtttctttgctttgccacgcgttaactcgttcaaaacgcttcaaaacgatgtgaaactggggtttcaaagtctggggatcgggaatttggattgggggagtcttggtgggcttagctcggtgcctgagctggtaccgagtggacaacctcaaactcaaactcagagtccggggattactagttatggaaatagtaacgtatatgtcagcacaatgccgcctacactttgtc

SEQ ID NO: 16116 - DNA, 813 bp, Gossypium raimondii
  Predicted polypeptide sequence is orthologous to G778
gagaaacccccttggtagctcatggcagaaccatttaataatattacaaattcaaagacaataatttgcaaacaaaacaaagctttgtaataaaataaaataaaaaacatataaccaaccacttgaaactaaagaattataatccgagttcatgttgttgtttttttctttttctttttgtgtataaataaaggcacattgaaagcttaactctttgaactagaagctggcggttgttgcatttgttgatacatagcggccattctactataagcatccatagtcatcggttgtgattgacaagcaaggaatgtagataaagggtctgtcattgaagcagcttgttgtaaccgatcattgttgttagaaccatcccaaggtgtattcattgtcatgaaaggattagacaaaacaggtgagataccaatgatgtttggtcggcccatgaagttcatgtccataacactcatccccattcccatcggtgccatcatcgacatttgaagttgttgttgcaacatcatcgatggtaagttcatcctattcatcatttggacttgtgcttgtaattgttttaagtattcaatcacttcatctaacattgaagctttgtctgtctgtaaaatggtaataaacattaagattatatcaatgcattgcatgcatgaccaagtcttgtgtcattagttagctgtttttcaaaggcaaatgacagattttcagacatgtcgaggaccaaataaggggcctaccatgaaagggtatttatgtggtagcaggtgattgtcgccacacctatcaacgtaaccctct

SEQ ID NO: 16117 - DNA, 894 bp, Gossypium raimondii
  Predicted polypeptide sequence is orthologous to G791
ctcaccatcacattcttccctcacagattccctcaaatcaaccaaattcactcgttccatatctccaatctatctctctgttctcttttgttttgttttcttcactttctgcatcaaacatcttccgctgtctggcataactgaatccttgccgggaaaaatgatatcccggcggcaaccgggtgcggaggacctggtctcctctgacaatcccaatgcttggatttttgatgattatggtttgttagaagacattcctgtccctggtggtgatcttccctcacttgacccttcagccccaatctggtcatctccttcccttacttgctctactcctctcagtgttgaattcactgaatcgtttgggaattcagacaatcttaatgaaacaggctcccgaaaacggatgaggtctggatcatccagtgcatctgggtccaaagcttgcagagaaaagatgcgaagggataagctaaatgacaggcatgtattgttgtccctatttctctcccttcaacccaatttgtttcctctgatatttatatgttaatgtctcaaggttcctagaattgggttctatcctagagcctggaaggtcttccaaagtggacaaggctgtaatattagttgacgctgctcggatggttactcaattacgggatgaggcccagaaactgagggagtcaaatgagagtctgcaggagaagattaatgagcttaaggctgaaaagaacgaacttcgtgatgagaagcagaggctaaagaccgagaaagataatctcgagcggcaagtaaaggcattaggttctcagccaggattcatacctcaggctcctgctattcctactccattttctacctcaagccaagtttgttggtgggaaactggtgcct

SEQ ID NO: 16118 - DNA, 665 bp, Gossypium raimondii
  Predicted polypeptide sequence is orthologous to G849
caagacgtaggaatgatattaagttccgtagtagagatgatgaagaaaacttttctaggtttaagacacttagcaagaggtttaaggcttctagacctccaacatgtaccggagaccgaagaataaggaagttgctgacatccaaatactggaaagttgctacaaagttgaaggattttgaacattctagatttggaggaaaaaggcctctgtatcgcaagtggaagacatactacaactaccacagatatcaatatgacacgctttataaacagaggaagatctttgaccgtaaaagcattactagttctcctgagaaggatatgaatggtgataagtgtagcacagctgcaatgtcagatagagtgaaatttagcatcaagtcctttaggattccagaactttacatcgaggtgcccgaaactgcaactgttggttcactgaagaggaccgtaatggaggcagtgacagccttaattgggggtggaatacgtgtcgggctactccttcaagggaaaaaggtgagagatgacagcagaactctatcacaggctggtatttcctgtgatgataatctggatgctctcggtttcactttggagcctggtcctgcaaaagctcctccaacatgtgctctgaagaaccacctctttttatatcatatg

SEQ ID NO: 16119 - DNA, 842 bp, Gossypium raimondii
  Predicted polypeptide sequence is orthologous to G849
cccagtccaaggattcccatgtgaaattcaccattaagtcctttagaattccggaactttatattgaggtgccagaaactgcaactgtcggttcactgaagaggacagtaatggaggcagtgactgccttacttggaggtggaattcgtgttggggtactacttcaagggaagaaggttcgagatgacagccgaactttatcgcagactggtatttcctgcgaagaaaatctggattctcttggtttcactttggagcctggtcctgcaaaagctcctccgccagtgtgctcggaagaaccaccccttctgatatcatgtgataaagcccctcaacaactaacaagccttccagccactccggttgtagatatggcaattcccgatgccacacctgatccactgttactaaccaatacagcacatcctgtggatagtaatcatgaaccggtttcctcccaaactgacgtgctaactgatcaaagtctatcggagtctagagctatagttcctgttccagcaatgaatgttgaggcactagctgtcatccctgccagcccgaaagtccgaaaaaccgaacttgcacagcgtcgaactaggaggccgttttctgttttagaagtagaagcattggtacaggcagttgaggagcttggtactgggaggtggcgtgatatcaaactgcgagcttttgagaatgccgatcaccgaacttacgtggatttgaaggataaatggaaaacattggttcacacggcgaaaatttccccacagcaaagacgaggggagccagtaccacaggaactgttggacagggtattagctgctcatgcatactggtct

SEQ ID NO: 16120 - DNA, 818 bp, Gossypium raimondii
  misc_feature (795)..(795): n is a, c, g, or t
  Predicted polypeptide sequence is orthologous to G852, G2633
ctccaacgattgggtgcttatgttcttgaacggcttagagcaagggtggaatcatcggggagtaatatctaccaagccttaaaatggcaagaaccgacaagctcggaactaatggcttacatgcatattctctttcgaatctgcccgtactggaagtttgcatacacatcagctaatgctgtcatcaaggaagtcatggaatacgagcagagaattcatatcattgatttccaaatagcacagggtacccaatggatgtaccttattgcagctctttcaaaacgccctggtgggcctccatttatccgtgttactggtattgatgattctcagtcaaatcatgctcgaggtggcggacttagtattgtggggcagaagctatcggaatttgctaagtcgtacaaagtgccattcgagtttcatgatactagcgtgtctacttccgagattcaagtacagaatctcaacattcgtcctggggaagccctagccgtgaatttcccttatgtattgcatcacatgccggacgagagcgtaaccatctcgaaccacagagaccgattgttgagattggtgaagagtttgtcccccaaagtcgtcacccttgttgagcaagagtctaacaccaacacatccccctttttttctcggtacatcgagacactcaattattacacagctatgttcgaatccatagacgtagcttgtccaagagacgacaagcaaaggatcagtgcagaacagcattgcgtggctcgggatattgtgaatatgattgcttgtgaagggcaaganagggtggaaagacacgaacttct

SEQ ID NO: 16121 - DNA, 768 bp, Gossypium raimondii
  Predicted polypeptide sequence is orthologous to G852, G2633
ttttttcttttttttgactaatggtatgaaaatttattagaaaaggcccactttggattataacatggttcaatatacaatatcatcatcatcaatcactataccgtacaacaaacctacctatcatctctaacctattgaaaaaaaaaagaatgtgattatttgtatattacctttgtatcattgtatgtatctcagttgttgcagcgccaagcagaagccgatataaggttccgatccttccatctcaacaacatagcaccatccttctccaccagtgtatagtgtttagagtaatacctcagtaggcttcttatcactgaattcacatatgagcttaatgggtattgtcggaatccggccattgttagcctggacttccattttcccaacagctcgtggcgttccactctctcctttccctcgcaagcaatgatattcacaatatccctggctaggcattgctgctctacgttgattctttcttttctgtcccttggaagtgtctcgtcgatggactcaaatattgctaagtagtactctagagtctcgataaacctggggaggaaaggggccgtgtttgtgtttgactcttgttctaataatgtggtaaccttgggagaaagtgacttcaccagtcgtagaatcccgtccctagggttgttcacgtcaacgctctcgtcaagggtgtgatggagctgcagcgggaagttgacagccagagcctccccaggcctgagactaaacatgtcccttgtgacatctggg

SEQ ID NO: 16122 - DNA, 816 bp, Gossypium raimondii
  Predicted polypeptide sequence is orthologous to G866, G883
gaaagaacttttgctttaagcataatctcaacgactttgtcagtctactttttaatttggcattacaattagtacaatacctatttacatccaattgccccaacctactccaaaatattacaaaacaccactaaactctttttttatgtataaattaacttagattaatatttgcttattatcacgttgactcgaagtccagtccattcccacggcaggagccatattctcctgcattgcgggttgagtgtgtcggtgctccccttcgtacgttacaatcaacattgacggatcatcgggggctcgctccacgtgtttcctagcggggcaccctctaacgctactgcacttataatatcctcgcgggaatggggagcctttgattggcttttgcccgtatttcctccatgaatactcgtctggtggaatatcggcgatcttcgaacttatggcaggaacccttattactttcttcaccctatttttccttcgctttgagcaatggcacttgctgttgccggagccagatctcttgccggaaacgttatcggagtggtcatgttcatggcatctcttcttgaacggtgtcgacgatagcggcggctttcccgtcgaaacggccagcgccggcgccaagaatagagatgatccctgcttcccgttcgagacgctgccgtctccggtgatggcagaagacataaacgaagagttagaggaaacgctaaagctttcttttgtgaactccaactcggtacttttaccgttggagccaaacaaattaggttttgtgaagtccagagtcaaactctgcggctg

SEQ ID NO: 16123 - DNA, 836 bp, Gossypium raimondii
  Predicted polypeptide sequence is orthologous to G866, G883
ctcttctacttttcgcaggcttcatgttctgttgacctctcaacttgcttagtttcctttggttgtcgtcgttgtttttcgtgaaaatggcggtggatctgatgagttttcctaagatggatgatcagatggccattcaggaggctgcaacgcaaggtatgaagagcatggagcacctgattagcctcctttctcaccagtctaaccgactcgactgcgctgaggttgccgatctcaccgtctctaagttcaaaaaggtcatctcactaattaacagaaccggtcacgctcggttcagacgtgcaccgattcagtcctcttccttttcctcaccgtcatcatccgctgcttctctaactgttactgattcccacaaggctctaactcgaactcctgccccggttgaaacaccgccgctgaccgtaaatccggcgccggttgaagctccaagtacggatcctgctagtttcgttcctttgcaaccccagagtttaacactcgattttacgaaaccttgtttgtttagttctaacactaaaagcactgagttggagttcacaaaagaaagcttcagcgtgtcgtcgaactcttcgtttatgtcttctgcgatcaccggagacggcagcgtttcgaacgggaagcaaggatcatctctatttttgacaccggcggcggccgtttcctcgggaaaaccaccactatcctctgctccattcaagaagaggtgccgcgaacatgagcactctgagaacgtgtccggcaacggcaagtgtcactgctcaaagcgaaggaaaaacagggtgaaaaaagtaatcagagttccagccatcagttct

SEQ ID NO: 16124 - DNA, 909 bp, Gossypium raimondii
  Predicted polypeptide sequence is orthologous to G872
gcacaatctgagcgaccttttctttctgttacaaattgactttcaattgatggtgaagccaatctgcacaacacattcttcagcatcacaaacagagtatgcctccgacataaacaccaacagctgcagcagtaatagcagtagcagtagcagtagttccaagtataagggtgtacggaagaggaaatgggggaaatgggtgtccgaaattcgacttcccaacagccgtgagcgtatttggttaggttcttacgactcgccggaaaaagcagccagggcgttcgatgcggctctttattgtttacgtggccgtgatgccaagttcaatttccctgaaaatccaccggagatcgccggtgggacgtcgcttagcccgccggaaattcaagtggtggcagctaggttcgccaaaggggtggaactggaaaccccggggaataacaacaatattgtagggacagaagagtatacatcgtcttcgtcgggcgggggagcgacaacgcaagtggagagtcgtcatcatgaagaagacatgatggactggtcgtttttgagcatgttggataataacaacaccaatgatggagggatgtccgattatggcttttattcaaatttgggccatttgcctggtggtgatgatgatgaactctatcctccgccgattgatgttgatgaaaacggtggcaacgctttttcaccgtcatcgtttctttggaacttttaagccaaatttagatttctttttaaaagcaaataaagttaacttttgtgtttatttgtttgatgggataaatcaaggcgtttggcgaatattagcagccaggatcggtgattttccacagatacagtgagatgatgagattccaatgataggaagggtggaggtgccatcttcctgtgtatact

SEQ ID NO: 16125 - DNA, 873 bp, Gossypium raimondii
  misc_feature (868)..(868): n is a, c, g, or t
  Predicted polypeptide sequence is orthologous to G878, G884
acaatggcagcagagcaaggaaaaagatcacagctatcagctccaacatatcccactataactttgccacctagaccacccattgatggcttatttcaatcaggttctgggttaagtccaggacctatgacactggtttcagcttttttctctgaccctgactcaacaaataggtctttttctcagcttttagctggtgccatggcttcacctggagctaaactgccttacaatcccatggatgattcatttatggaagtgggttttgaaaatggaggtgaaaagaattctgggtttaaacaaaatagacctttgaatttgggtgttggtaattctccttggttcactgtgcctcctgggttaagcccttctggtttgcttaactctcctggtctcttttgcttatctcctcagagtccttttggaatatcgcaccagcaagcattggcacaggttacggctcaagctgctctagtgcaatctcatgtacatgcgcaaccggaatatcaaactttgtctgctgcaacttcttcggaaccatcgatccctccttcatctgccaatcctgaagaaactttgcagcggatgctttcttcagaccctcaaagttctgcaatggaatgcttggaagcttctcaattcgataaaaaaagtcagccttgtgttgctgtcgataaaccggccgaggatggttacaactggcgtaagtatggacagaagcaaattaaaggttgtgagtatccgcggagctactataaatgtacacatccgagttgccctgtcaaaaagatagtcgagcgttctgccgagggcctaataactgaaattatatacaaaagcacacataatcatgaaaagcctccaccanataaa

SEQ ID NO: 16126 - DNA, 888 bp, Gossypium raimondii
  Predicted polypeptide sequence is orthologous to G896
gttcgaatcgatggcacgaagagaacgatccattggttgtgggagtaacatgttggtttcacccgaggcacgagtcgttcgttgttcccagtgccacacccttaccaaccttgtcccaatcaatgctcgaccaggccgaaccaggtataatgggctgccgagaatgcatgaaaacccatacgggaacggcccaagtccgcaacatccacaatatccacaaccgcgaccatccttatctccagttccgatttacgggagaaaacgagcacttctttgtggtgtgaattaccatggaaagagttataaactcaaaggaagtatcaatgatgtcaagagtatgaagtaccttcttgtggagacattaggatttcccaatgattccattttaatgctcacagaaaatgaaagggagccttcaaagatcccgacaaaacagaatatccgaaaggctttgaaatggctggtctatggatgccaaccgggggactcgttggtgttccatttctctggtcacggcactcgacaaaaagattacaaccatgacgaagtcgacggatttgatgaagcattgtgccctcttgatcacgaaaccgaagggaacataatcgacgacgaaatcaacgacaccatcgtaaaaccgttgactcgaggaaccacactgcacgcgatcatcgatgcctgctacagtggaacagtcctcgatctccctttcgtttgcaggatgaacaaggaagggcgttatgcgtgggaagatcaaagaaatcccttatttaacaagcgtacaagtggaggattagccttttgttttagtgcttgtgatgatcatcaaacctctgctgataccactgctttcacaggaaccaatgtgagaaccggcgcgatgacata

SEQ ID NO: 16127 - DNA, 857 bp, Gossypium raimondii
  misc_feature (58)..(58): n is a, c, g, or t
  Predicted polypeptide sequence is orthologous to G896
caggcccaacgctaattccacctccttcttttcttcttcttcatcattagaaattccncttttttccccaaataattttttttaggaattaacctttgagattttgaataatgtatccgccgccagggccaggaggcatgtactacaattacccgccgcctatgctggtcaactgctccggctgccacacccctttgcagcttccgcaaggtgcccgatccatccgttgtgccatctgtaaagccgttaccaacatcgctgaccctcgatccctccctcccgcgtcccaaccacctgctccttccacccacgcgcctccttctccctccccttacaatcatgctcctcccggggcacctccccacgcccacggtcgaaaaagggcggtggtctgtgggatttcgtatagatactcgaggcatgagctcaaaggttgcatcaatgacgccaagtgcatgcgttaccttctcgtcaacaagtttaagtttcccgaggattccattcttatgctcacagaagaagaaactgatccctacaggcttccaacgaagcataatataaggatggcattattttggttagtacaaggttgtcaacctggtgattctctgttatttcactattccggtcatggttcacggcaacgaaattacactggtgatgaagttgacggctacgatgagactctttgccctttggattttgaaactcaagggatgattgttgatgacgagatcaatgcaactattgttcgacctctacctcatggtgttaggcttcatgcgattattgatgcttgccatagtggaactgtattggatttaccattcctttgtagaatgaataggactggacag

SEQ ID NO: 16128 - DNA, 898 bp, Gossypium raimondii
  misc_feature (869)..(869): n is a, c, g, or t
  Predicted polypeptide sequence is orthologous to G926, G2632
gttatggttgcagagagagccaaactgcaatcaatctctaggcatttgcttctccaattccaatcttctttttctttttctttttttactaataagtcgtgagaaatgccagcaaaaccagggaatgatgatcagcagatagaccatggggctcaaagtgtgttgcagtcaactgcctactctgaaccctggtggaaaggagttgggactaacccctttggtgaagctgcctcgaagtcgccttctgtagaacaactaaatggttcagtggcaaatggagctgtgcattcacaggctcatggggacttgggcaatgaagatgggataaacagacaagatcgccaacatctcaaacacgttccttccacaacaccccttactttgggtgaacaccatgaaccaaattcccaaatggaactagttggtcactcgattgtcttgacatcatatccttattcagatcctcagtatggtggaatgctgacttcatatgggccacaaatgatggtttcaccacatctatatggaatgcatcatgctagaatgcctttgcctcttcaaatggaagaggagcctgtttatgtaaatgcaaagcaatatcatggcattttgaggcgaagacagatacgtgctaaggctgagcttgaaaagaaagccattaaaattagaaagccataccttcatgagtcccggcatctacatgctatgagaagggctaggggttgtggaggtcgttttcttaatacaaagaagcagggtgatgatgttaccagccccacttcacaaaagggcatgaattcagatgaaaacatttcaaccaaatcatctatcttgtctgggtctgagtgcgtatccgcaaatggtgctgngaatatgaattccttctatagtcagcaag

SEQ ID NO: 16129 - DNA, 853 bp, Gossypium raimondii
  Predicted polypeptide sequence is orthologous to G938
gagattgatgtggatgaacttgagagaacgatgtggagggacaaaatgcgtctcaaacgacttaaagaacagaacaagagcaaggatggggtcgatattgtgaaacagagacagtctcaagaacaggcgaggaaaaagaagatgtcgagggcacaagatgggatattgaagtacatgttgaagatgatggaagtgtgcaaggctcaaggttttgtttacggaataatcccggagaaaggaaagccggtaactggggcatctgataatcttcgggaatggtggaaggataaagtcaggtttgatcgtaatggtcctgccgctattgccaagtaccaggctaataattcgattcccggcaacaatgatgggtgtaacccgattggtccaacaccacacaccttgcaagaacttcaagatacaacgctcggttcccttttgtctgcactgatgcagcattgtgatcctcctcagaggcggtttcctttagagaaaggtgttcacccaccgtggtggcctactggtaacgaggaatggtggccgcatctcggattgcctaaagatcaaggccctcccccttataagaaacctcatgacttgaaaaaggcttggaaagtcggggttctcacagcagtaatcaagcacatgtctcccgatatagccaagattcgcaagcttgtaaggcagtctaagtgcttgcaggacaagatgactgcaaaggaaagtgcaacatggcttgctatcatcaaccaggaggagaccttggctcgagagctttaccccgagtcctgcccagctttgtcctccgggggaggaagtggatctttggttataaatgactgcagtgagtatgatg

SEQ ID NO: 16130 - DNA, 858 bp, Gossypium raimondii
  Predicted polypeptide sequence is orthologous to G938
caaagtcaggtttgatcgtaatggtccttctgctattgcaaagtaccaggcagataattcgattcctggcaagaatgatggctgtaactcgattggcccaactccacacaccttgcaagaacttcaagatacaactcttggttctcttttgtctgcactgatgcaacactgtgatcctcctcaaaggcgattccctttagagaaaggcgttcccccaccatggtggcctactggaaatgaagaatggtggccacaactaggattgcccgaagatcaaggccctcctccctataagaaacctcatgacttgaagaaggcttggaaagtgggggttctcacagctgtgatcaagcatatatctcctgatattgccaagattcgcaagcttgtaaggcagtccaagtgcttacaggacaaaatgacagcaaaggagagttcaacttggcttgccatcattaaccaggaggaagccttggcccgagaactttaccctgattcctgcccacctttgtcctcaggtggtggaaatgtatctttggttataaatgactgcagtgagtatgatgttgaaggtgttgaggatgagccgaacttcgatgtgcaagagcgcaaacccaggactatcagttctaatttggtcatggagagaatgagggctatccaacaaccaccttattcgactaagggggaagttgtcagtaatttggatttcacgcgaaagaggaaaccatccaatgatttaaacatggttgaacaaaaaatctacacttgtgaattcctccagtgcccttacagtgaatttcgtttgggttttcatgataggactgccagggacaatcatcaattgacttgtccata

SEQ ID NO: 16131 - DNA, 836 bp, Gossypium raimondii
  Predicted polypeptide sequence is orthologous to G989
cttgatgatagaaattttctttcagtttctcacctcccaaacaggcccagcaactttcaatctctgacacaactctgcaaaaaaactctgtacaggaagaacttttgttagtcctcttcaaaagatatttgtcccttttctcccaaaagttcctcacctttcgaatctattctcctttctctctttctctctctcttaatcgatcatgcttcaaagcttagttcctcaatctccaatcagttccaacactactagctctaatcctagctcctccatgaagtcaaagcgcgtcgaaagagacgtctccgcagctaccggcgaagattccactgctgatgatccttctaacaagcgtcctaactactcctccggcgacaaagcagctgccgccgatgaacatgatgaaacggtgatagaaggtgagtctacagggttaaggcttttaggtctcctgctccaatgcgccgaatgcgtcgccatggataacctcgaggacgccaccgatcttttacctgaaatatcccaactctcttctccgttcggctcatctcccgaacgtgtcggcgcgtacttcgcacacgctttgcaggcacgcgtggtgagttctagcttaagaacctattctcccctggataacaaatcacttaccttgactcagtcccaaaagatcttcaatgctctgcaatcttacaattcgataagtcctttggtcaaattctctcacttcaccgccaatcaagccatcttccaagcattgagtggtgaggattgtgtccacgtcatcgatctcgacatcatgcaaggtctccaatggccaggattattccacatcctcg

SEQ ID NO: 16132 - DNA, 862 bp, Gossypium raimondii
  Predicted polypeptide sequence is orthologous to G1017, G2567
gacgagccaggcatgctcattacggcctatctttatcagatctccacctcaataaactgcagtcagcgtctctttccggctagtttcccaccacttgattacgctcctgtacctaataggacctccaatggtggcccaaacattcgaaagcctagcatgagtgagaacgtttcttgtgtgctaaccatgtcccatccctcacagaataccaagaaagctgatggtgcaaagacacctcagcttgtacttttcggtcggccgattcttactgaacagcaaatctctctcagctgctctggtgatacaatctcaccagttcttactggaaatagttcttcagaatatctggataaggcagcaaacttttccgatggttctggatctgctcttcatcaacaaggccttcctgagcgagcatcctgcgaaggtctcccgtggtacaaaaacagtcgccaagaaactgaacccaatttagagaccggtcactgtaaagttttcatggaatcagaggatgtcggtcgtacactcgacctttctttgctggggtcttatgatgaactgcagagaaagttggcagacatgtttggtatagaaaactccgaaactctgagccatttactctatcgggatgctacgggtgctgtcaaacaaattggagaagaaccattcaggtagaactcattcaccttgtatgtttatgggttaatgcccttacaaagggcatggtaatcaatttctcattgccattgcagtgactttatgaaaaccgcgaggagattaacgattctaacggattcaagcagcgacaacgtaggagaatatagaggaagaagcaaaccttggattcaacatgtacagctga

SEQ ID NO: 16133 - DNA, 1459 bp, Gossypium raimondii
  Predicted polypeptide sequence is orthologous to G1017, G2567
ctgtttattcctcacgcgagaaagtgaaaccattaaaggtacagcagagagtctgaaaaggctgaatcggacaatcgatgaaggaatcagataagagcttagatccacagttatggcatgcatgtgctgggcccatggttcaaatcccaccattaaactccaaggtcttttacttccctcaaggccacgccgagcactcactcgccgccgtcgatttcccctcgtctccgccggtcccggctctagttctttgccgagtggcttcgctcaaattcatggcggataccgaaaccgacgaggtatacgccaagatcctcctcatgccgttacccaacacagagctcgacctagaacacgtcgccgttttcggctccgataacgcggagaagcctgcttctttcgctaagacattgacccaatccgacgccaacaacggcggtgggttttcggtcccgaggtactgcgccgaaaccattttcccgccgttggattacacggaggaccctccggttcaaaccgtcgtcgccgtggatgtccacggtgaaacgtggaagttcaggcatatttatagagggaccccgaggaggcatttattgactacgggatggagcactttcgtgaaccataagaagctcgttgccggcgattccatcgtgttcttaaggtccgaaaacggcggcctgtgcgtcgggatccgacgagccaagcgcgggactggaaacggacccgaagctgggtctccatttttgtctttcttaagggaggacgagagtaagatgatgatgatgaaccgaaatggggattggagaggaaaggggaaactgaaggcggaagctgttttacaggcggctacgttggcggccagcggtcagccgttcgaggttgtttattacccaagagcgagcacaccggagttttgcgttaaggcgtcgtcggtgaaggcggcaatgagggttccttggtgttgtgggatgaggtttaagatggctttcgagacagaagattcttcaaggattagttggttcatggggactgtgtcttctgttcaagttgtcgatcccattcggtggcctaattccccatggcgactttttcagttggaggagttgagcacccaagttcctcaagggctagcatgggacaacattggagggccaagcattcccccttacaatcgcctcacagcagctcaatttgaggcattttttcaccctcctggggccaattgctcttcacaaatcggatatagcaatgatgtggtttcggatgagatgaatggggcagtgcatagccaaaatgtgaacgggtatttcccaggatggatgctttaattatatctagctacctacttttcattatttatttaaacaaaaattaacgcaacttgtaattatatttgtatgaatgccaataaacataaccatgaacatataataaattgtaaggacttaatttccct

SEQ ID NO: 16134 - DNA, 914 bp, Gossypium raimondii
  Predicted polypeptide sequence is orthologous to G1020
tcaattcccccaccattttttcctctctcaccattatctcatcactcttaaaacggagcttcctaaatggccctgagggagaaaacggcggacgtcaagggaaacgggaatgggtgtactaaagaggttcattttagaggagtaaggaagcgtccatggggtcgttacgccgctgagatcagagatccagggaagaaaagccgtgtttggcttggaacttttgatacagctgaggaagcggccaaggcctacgatgccgccgccagagaattccgcggcgccaaggcgaagactaatttccccctccctggtgaaatcctcaacaatggtagtaactgtaacaacaatggcgataccaactgcagcaacaacaataacaatcacagccctagccggagtagcaccgtggagtcatcaagccacgagccgccgacagtcgtcaagtgttcaccgttggatctcaatctcggacacggtgcagtcatcgggtacggatctccagccgtcaggcttcctttccctcaaatttcgtcggtcaccggttttttcgccaacggcgtcccggcagttgcagccccccaagttttttacttcgacgcgttggtccgacccggtgttatgaaaggacagcagtatcaacaacggttgagattcgatcaccgtgattatcacgaaactttcaacgctggtgtacaaagcgactcagattcgtcctccgtcgttgatttaaaccaccacgagatcaaacggcgaccgcttctcaatatcgatctcaaccaacctgctccggaagtcgcgtgattattattttttaaaattgccgatatcaagaaccggaaaaaaaaaacccacaaattttcaattttccctctttaaaatcgttaatcttctttttagtcccaaatttgaaaatt

SEQ ID NO: 16135 - DNA, 918 bp, Gossypium raimondii
  Predicted polypeptide sequence is orthologous to G1043
ctttatccatggcctgaacctgaaacactatcaagcaacaagaaaagggtaatacaacaacttgcggaaggtcaacagtgtgctactgagcttcaagttattgtactccagaacaacaagccctctcaacaagctgaggagcttgtgcaaaagatcctgtggtcatttaatcaaacaatttctatgctatctgaagctggtcatcatgatgaagtgatttcccagaatcaggctacttgcaatgatgattgtaagtctcaagattctagtgagagcagcaagagatcactttcagcattcactaaggacaagaggggctgttacaagagaaagaggtttgctcaaacaagcacagtggtgtctgataaaattgaagatgggcatgcatggaggaaatatggacaaaaaatatcctaaattctaaacatccaaggagttactttaggtgcagtcacaagcatgatcaaggctgtagtgctatcaaacaagttcaaagaatggaagatgatacccaaacgtaccacatcacatacattggtacccacacttgcagaggccagtacccatccatggctacaccacgaatcgaccgtctgagtccgatattaaaactcgaatccgaggaacaaacgacgacaccaagcgatgttacggatttggattcgatgaccatgtggacggatgtaatgatgggtggtgttggttttgaagctgatgcggtgtccaacatgtattcatgcactgaaatcacttgtttggatttagaacctgttgagcttgaaaatggtttgcagtttgattaccctgattttgcttcgtaaaactttggcttctttgtacagttaatattataagccatgttccctatttgtattatgtaatcgacgggcaaattatgttgttagtccctgtacttga

SEQ ID NO: 16136 - DNA, 870 bp, Gossypium raimondii
  Predicted polypeptide sequence is orthologous to G1051, G1052
cagtttatatcattggcttcaaggacttactattatatgatgttggtgtttgggtttgggggtttgagttgatagatgtgtgtgtcgtgtaatatttttgtgtgtttggttgtatagttagttgttggttagtttaagattagctttgtttttcgtgctcttttatttatttatatatattttttgagtttttggggtttgtgacattggtgtagaatggcacaattacctccaaaagtacccaacatgacccagaattggccttcttttccacatcaaagattgcctacaatggcaaacatcatttccaccactgccaacaccgccactatgaatgcctcccaccaccaccagccttcttgggtcgacgagttcctcgacttctcctccgcacgccgcggggcccaccgccgttccattagcgactccatcgctttcctcgagcaaccattggtggaggaatgcagggactccaacaccaaccacaacaacaatgccatgataacggaaaccaatgtgttcgatcgtctcgacgacgaacagctcatgtccatgttctccgacgacgtagccgtcaccatggctgctgcaccgacgttatcctcgtccaacccttccactccgacgtccgaccaaaacagcaacaatgacgagaaaccactgccgtccctggatctgcagcagcccaagaacgaaccaggagaagtggagagctcatgcaaacctgaaccacaagctgctcaacctccatcaacctccaatggcgaccccatcgttgatcccaaaagggttaagaggtaaaacaaatcaaaacccattattatacaacattttttaccccattataaatattttaaattttattttggg

SEQ ID NO: 16137 - DNA, 869 bp, Gossypium raimondii
  Predicted polypeptide sequence is orthologous to G1146
cttggtattgtttccagtgctgcttgaccaatatgtatttagaatgagcaaacaatatttggccaatgtggcattgaaaattaatgtcaaggttgggggaagaaatactgttcttgttgatgcaatatcacgaaggatacctcttgtcagtgaccgtccgactataatttttggtgctgatgttacccatcctcaccctggggaggattcaagcccttctattgcagctgttgttgcctctcaagattggccagaggttacaaagtatgctggcctggtttgtgctcaagctcatcgacaggagctcatccaagatttattcaagacatggcaggatcctgcaagggggactgtttctggtggcatgattaaggagctcttaatatctttccgacgagccactggacagaagccacagcgcattatattctacagagatggtgtcagcgaaggccagttctatcaagttctgttatatgaacttgatgctattcgtaaggcatgtgcctcattggagccaaattatcagcctcctgttacatttgttgtggtgcaaaaaaggcatcatacaaggttgtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacagtttacagctgatgcattacagtcccttacaaataacctttgctatacatatgcaaggtgcacacgatcagtgtcaattgttccccctgcgtactacgcacatcttgctgcatt

SEQ ID NO: 16138 - DNA, 832 bp, Gossypium raimondii
  Predicted polypeptide sequence is orthologous to G1146
ggaatacagttcttgttgatccgatatcaccatgaatacctctagtcagtgaccgcccgactataatttttggtgctgatgttacccatccgcaccctggggaggattcaagcccttctattgcagctgttgttgcctcccaagattggcccgagattacgaagtatgctggtttggtttgtgctcaagctcatcgccaggagctcatccaagatttattcaagacatggcaggatccagtaagggggactgtttctggtggcatgattaaggagctcctaatatctttccgaagagcaactggacataagccacagcgcatcatattctacagggatggtgtcagtgaaggccagttttatcaagtgttgttgtatgaactagatgctattcgtaaggcatgtgcttctttggagccaaattatcagcctcctgttacctttgttgtagtacaaaagcgacaccacacaaggttgtttgctaacaaccataatgatcgcaatgctgttgacaagagtgggaatattttgcctggcacagtggtggactccaaaatctgtcatcccacggagtttgacttctacttatgtagccatgctgggattcagggtacaagccgtccagctcattatcatgtgctatgggatgagaacaagtttacagctgatgctttgcagtctcttacaaataacctttgctatacatatgcaaggtgcacgtgatctgtgtctatcgttccccctgcatactatgctcatcttgctgcattccgagctcgtttttacatggaaccagagacttcagacagtgggatcatgataagtggccctgc

SEQ ID NO: 16139 - DNA, 846 bp, Gossypium raimondii
  Predicted polypeptide sequence is orthologous to G1181, G1850
tctgaactttctagaatttaacaatcagacttctcatctctggtgaacgaaacaaacaccttctttaaggaattattaattatcgtctttgatggctccgccgccggtggagcaaaacggagatgcaacgacgggaacggcggaatcacaaaggtctattccgacaccgttcttgactaaaacgtatcaattggttgatgatcacacgattgacgacgtgatttcgtggaacgacgacggatctacttttatcgtttggaatcccatggtgttcgctcgtgatttgcttcctaaatatttcaagcataacaatttctctagttttgttcgtcaactcaatacttatggatttagaaaagtggtgcccgatcgatgggaattctctaacgattattttcgacgaggtgaaaagcgacttttgtgcgaaatccagcgacggaagatctcgtcgccaacagcagcagctgttacggtggctccggtgacggttgcggctattccaatggcgaagcctattatatcaccgtcgaattctggagacgagcaatctccagtcatttcatcggcctcatcgccttcaaggctgaaccaagcaggaaccgttatggccgagctcatgaaagaaaacgaaaaattgaggaaagagaacgtgcagcttaacaaacaattatcagagatgaagagcttgtgcaataatatattcagtttgatgtcgaattacgcaagttctcagtcggagaacatttctcccgtgcacaaaccgctagatttcttgccggcgaagcggttatcatggggagaatcagtcgaagaagaaacgagtccgaggttattcggcgttccaat

SEQ ID NO: 16140 - DNA, 914 bp, Gossypium raimondii
  Predicted polypeptide sequence is orthologous to G1190
cactatcgaagagcagagagcagctttagagaagttgcaggacttattgacatcaatgtgctttacagtgtatgctacacaggatgatattgctgtgtggcagaaatcatcagatattggctgctatgagaagctcaccggtccagatgtctacccaggcacgtgtgatgacagtatcgaacaggatgcagcatggtacactccgttacgcccatgtgttacatctccaagacaaaagcttaagaggtcatccgtgggttccctgccaaagtggccacagaggttaaacatcgcacctgagcgcatttcagatgttcctggtgggagtggcaatgctttaaagcgcgatgacagcaactggaaagtgcgagcccagcactacaaaaagatcctcccagcaattgggactgataagattagaaatgttatggacatgaatacagtctatggaggtttagctgcagctctcattgatgatcccttgtgggtcatgaatgtagtctcttcctactctgccaacacattacctgttgtctttgaccggggccttgtcggcacttatcatgactggtgtgaagctttttcgacatatcctcgaacatacgatctccttcacctcgatggcctttttgccgccgagagccataggtgtcatatgaagtatgtgctgttggaaatggaccgcatcctgcgaccggaggggcacgcattaatatgggaatccagctacttcatggatgctatcgagaccattgcgaagggaatgaggtggaactgccacaaagaagatactgaaaatagtggagagaatgagaaaatactagtatgccagaaaactctgtggtatgcctcctctactaacagtacaagatgatcccaaaagtcttctttgcctggttaaaaccataattatt

SEQ ID NO: 16141 - DNA, 705 bp, Gossypium raimondii
  Predicted polypeptide sequence is orthologous to G1202
aactatcagcagcggcggatcagtcccatagtcgtcgaccatgatactccacaacgcggtggtcgtcacaatggattctgattgccgagtctttcaaaacggagctgttttcatcgacaaagacaaaatcaaagccatcggtcaatctcccgatattcttcaacaattctcccatgtcgctcaccacatcctcgacctccacggtcaaatattgcttccaggattcatcaacacacacgttcacacttcgcagcagctcggtagaggaatcgccgacgacgttgatctaatgacgtggcttcaccatcggatctggccgtacgagtccaacatgaccgaagaagactcttacatctctactttactttgcggagtcgaacttattcactctggtgtcacgtgcttcgctgaagctggagggcagcacgtgactggaatggccagagccgttgagttgctgggattgcgagcttgcttaacggattcagtcatggactccggtgatggtttaccgccatcgtgggggattcgaacaacggatgaatgtcttcagtctcaaaagaagctttacgagaagcacaataatacagcagatggccgtataaggatatggcttggaattaggacagttatgaactctactgatcgtttactgcttgaaaccagagatgccgctagagaattaaaaactggcatccatatgca

SEQ ID NO: 16142 - DNA, 960 bp, Gossypium raimondii
  Predicted polypeptide sequence is orthologous to G1206
gggattagatctctcaatggaagggaagatgatgagtttttagggaagctgttataaggtctacgaagaatttataagatggaatagtaaaaatgattggcatctattgtaagcaagttcagctgtgtgttccaaaagttgcatacaaataggtcaagttaaactccggggaaaagaaaagaaattctcagctcggatagtctttaacaattgtccgagcaaatacaaaaaggtcggttccatggttgcagttgtcgaagctggcttcagtttggagttgatatcagttcagataattctttaacagctcgttctactgcataaataatcatcttcctaatctgtttacacgaaaccgtttgcaagtaaggttttgcaggaaataaataagtcgaaacatcaacgaaaggatgtgcctacctcaagtttgtcttctctggctctatggttcttgggtagtttccggaactcctctgttaaacggaggcattcctggatattctctggagaaacaaagtccaaggcgacttttgtgcatgactggaaaacataactatgagagaccataaacatgtgttccacaacatggaacgataatgcatgtattaattaaataccttcaggtttctaacttggtgcggacatccagccggaataaaaacagcctctccgagattttgctcaaacgtccatggttcaactcctaggaatcacgcgcataattgcatgaggaaaaagacgaaaaaacacggtataggcaaagtttttacattagacaacaatatgtcattctttgtactaaccatatttctcctttagtctccttttgtgctccgcagttaggtaaaatgattggtcatgaatcggatggattacctgatcataaacacagccatcaagaaacgtgagtgactaccactttaaggagtttttctttcaatgcagatggccaaagggttt

SEQ ID NO: 16143 - DNA, 733 bp, Gossypium raimondii
  Predicted polypeptide sequence is orthologous to G1206
ttttttctttttttttaagtaatcattttgtaattttctctaatttgcctaccaaagaagaaaagaaaaccataactgagtgacctctactgtaatttacccattggttttctatatcatgctgctactttattacaacatctactaaccttttgcctttaactatcaattggtgaaggtaaatattttgacacatacttcagaggtagccttaagcgatgagcagcttgccgcaatggagaagttgaaaatgaaacacaaggcacaggatgaaaaggaaagtttagaaagagagcgacttaaaaaaggctttgatgaatcggaagccaccaattggggtgataatatactatatgtttccagtggtgagtttagaggagcttcacttccggaacccttgaccagcagaaaggacataggtggtgcactgtgggacatttttaggagggaggatgttcctaaactagaagcttatttgagagagcactacacagaattcaggcatacctattgctccccagttgaaaaggtaagccatgggggagcacttttagaattaaatcgagaagcttactgggtaaaagcactttttttaaatcgtaacaatgctaaaccctttggccatctgcattgaaagaaaaactcctttaagtggtagtcactcaacgttcttgatggctgtgtttatgatcaggtaatccatccgattcatgaccaatcattttacctaact

SEQ ID NO: 16144 - DNA, 821 bp, Gossypium raimondii
  Predicted polypeptide sequence is orthologous to G1255
cttctacttattatttctgtctattccatttaatgattactgacaagaaagcagcgaatgtcatggcatgcaagacggctagagcctgtgatggttgtttgcagaagcgtgcacgttggtattgtgcggatgatgatgcctttctttgccaaggttgtgacacatcagtccactctgctaatcagttagccagcagacatgaaagggttagtcttcaaactgcatcctctaatttcaatgcttcgatgcacagtactattgatcaagatgctccaccggcatggcaccaaggtttcactcgaaaggcaagaacagcaaggcaaaacaagcccatgttggggcaacaaaaaggtgaggggaccgtattggctttgaatcctattgatccttttgttcctgaggttggtagtgaagaagggtcagttgatgaaaacgaagagcagctgctttgcagagtcccagtattcgacccttttttctgaagaattatgtaatatggtaacaagtgattgtgatgaagttgccacgccaaatgaagatgggaatttagttgttgatggttatgaacatgaaagaacatatgagttggatgatagtttgcatggctttttaccgtcagatttggatcttgccaattttgcagccgacgttgagagcttgctaggagttagacttgatgaagattcttgtgatatcaaaaaaattgaatcgttagactgcacagatgaaaatggaagcgagctatttcatgaacgcaaaataatgaaaagttgaagaggaagaagaagtggaaggtataacagcttgtttctgtgaatctg

SEQ ID NO: 16145 - DNA, 606 bp, Gossypium raimondii
  Predicted polypeptide sequence is orthologous to G1255
ctttttttttaaaaaaatgggaaaaagggaaaaaaatccttcccccttatttatttattaaaattatggggagtttgaaaacattgggggctaagcaccaggaactagggagtacatcaggggggacgagaaaaaaaggatttgaaagggctacttgttgagcaatggaaaagcagggcctggaaaaaaggatgcccttttgacaaacctccctttcattcgagggctcttctccgcattaagtttgcgaaccccgtaccttattttcttggaaaacaaccttggtccccgcttttctctggaccttgaaactcttggttctctacccccgccccccattggcgggtggtggccccccattcccatcaaaccactatagctctggtgaacttctggtccaccatttcccatggaatctggccagcattcgtctggggccaaatctggtttgcccccaaaagtccaaggaaacccttgggttgcccagggggggattacggcttcataatctaagctcaaaaggggcttccttttcttcttttttgcagaattcccctgaaattccccaccctttttactcttcacttctacctcttcctttaccaa

SEQ ID NO: 16146 - DNA, 897 bp, Gossypium raimondii
  Predicted polypeptide sequence is orthologous to G1272
tcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcatatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagggaccacaaggccgacccactatcatgttct

SEQ ID NO: 16147 - DNA, 781 bp, Gossypium raimondii
  Predicted polypeptide sequence is orthologous to G1451
gtgactcagtcctttttatttggaatgagaagaatcagttgttgctgggtatccggagagcaaatcgtcctcagactgttatgccatcttctgttttatcaagtgacagcatgcacattggtcttcttgctgcagccgctcatgcggctgcaaccaatagccgttttactatcttttataacccaagggccagtccttcagagtttgtcattcctctcgccaagtatgttaaagcagtctattacacccgggtttctgtaggcatgcggtttagaatgctgtttgagacagaagagtcaagtgtccgccgatatatgggtacgataactggcattagtgacttagatcctggtcgctggccaaattcgcattggcgctctgttaaggttggctgggatgaatccactgcaggagagaagcagccaagggtgtccttgtgggagattgaaccattaacaaccttccctatgtattcatcacccttccccctgcgattgaaacgaccatggccatctgcgctaccctctttccatgctttcaaagatggtgatatgaacatcaattcccaaatgatgtggcttcaaggtgggattggagatcaaggacttcagtctttaaacttccaaggttttggagttgcaccctggatgcagccaaggcttgatacttcttcaatacaaggtgtccaacctgatctttaccaagcaatggctgctgctgcatttcaggaaatgaggactgttgattcatccaaattaggctctcagtctctcttgcaatt

SEQ ID NO: 16148 - DNA, 815 bp, Gossypium raimondii
  misc_feature (17)..(17): n is a, c, g, or t
  Predicted polypeptide sequence is orthologous to G1480
acttcaaaccctccacnggttgactcctaacataatatttttttatttccattgctttgatttgattcgcgattatgggaatcgaaataagcggcggcacgatcattccaggaggttggggggccgccgccatggctgtcgcggctaagacatgcgacgcatgtaaatcatcggcggcagctatcttttgtcgtactgattgggtctttttatgcttgaattgtgattccaatttccattccggtcacgaaagggtgtctatgtgtgaagtttgcgaacaagctccggcggctgtcacttgtaaagccgacgcggcggctctctgtgtcacttgcgacgccgatatccattcagcgaacccactggctcgccgtcacgaacgtgtacccatcgaacctttctacgactccgctgattccatcgtcaaatcttccccttttagcttccttgtgccgacgacggatcataatggtactaattgtaaacaagaaattgaatctaacaaaggggatttttttttcacagaaatggatcggtttatcgatttcgggtacccgaattcatctcaacatcttcatgatgccgccatggatagcgttgttccagttcaaactccaaaaccagtcattccactgatcaacgatggaagctgtttcgatactttcagctatcaaactcaatcatctctcagtcatagcgtttcatcatcgtcgcttgaagtaggaacagttccagatgggaattaccacgcgacacaagtgggtggttcaatcgatcgagaagctagggttttaaggtaccaagagaagagaaag

SEQ ID NO: 16149 - DNA, 866 bp, Gossypium raimondii
  Predicted polypeptide sequence is orthologous to G1480
gaaaaggagaaagacagtagatttgtttaaccccagcaactcgttgaaatggcgtccaagttgtgtgactcatgcaaatcagcgacggccactctgttctgccgtcctgactcggcttttctttgccccaactgcgactccaaaatccatgccgccaacaagctagcctcccgtcacgctcgggtcttggtctgtgaagtttgcgaacaagcaccggctcacgtcacctgcaaggctgacgcagccgctctttgcgtcacttgtgaccgtgacatccactcctctaaccctctcgctcgccggcacgagcgggttcctttggctcccttttacgattccgtcaagcccaacacagcgtttaacttcctggacgaccgttacttatccgacgtcgatggagacgctgacagcagcagggaagaagcggaggcagcttcgtggttgcttcctaaccctaaccacaaagcacatgaaagcccggacgtgaacacggggcagtacgtgtttcccgagatggatccgtatctagatctggattacggtcatgtggatccgaaaattgaaacccaggaccaggagcagaacagttctggaactgatggagtggtccctgtccaaagcaacaccgtccaagctccgatggtcaacgatcactgtttcgacatggagttcactacaccaaaagccttgccttatggctacaactacaactgtaactacaaccctcactgtcttagccacagtgtatcatcttcttctctggatgttggggtagttccagatggcggtagtacgattacggacatatcagtcccgtgcgcgaaagtgacggagacgactcatcaggcggtgcaactctcatcggc

SEQ ID NO: 16150 - DNA, 883 bp, Gossypium raimondii
  Predicted polypeptide sequence is orthologous to G1512
gatcaaaaagagaaaccgcaaaaacaaagctccgatatcctggtttttttttttcaaagttaaaacccagttttcattttggtctgtttcagcttcctctttacctaatggctatggaaccaaacttctttgaacaagaatcacatttcgagtctgatggagatatttcactcaagaacaaatggaatccaataccagaaccaacaaaagacctagaaaaagattccagctgtttcgattgcagcatttgcttcgagtcagcacaagagccagtagtcaccctctgtggtcacttgtattgctggccttgcatttacaagtggcttaatgtccaaacttcttccctcgatacagacccgcgacagaagaactgccccgtgtgcaaggcaagcatctcttccggttcattggttcccctctacggtcacggcacatcttcacattctcaacccaagaatccacagtcagatctgaacattccccaaagaccacctccttctacatcgaacatgaccgccccttcttcgcatctaaatcaacagcttcacgaaaactttttccattctcagtctcaagcatttcataaccagcaatacttcccaccttatggaggatatgcaaccttggcatcatccgaccttagtggaataccgatgacgaatttcttccatccgatgatcggaactttgggagaaatggtgtatgctagaatatttgggagctcaaacacaagtatgtttgcttaccctaaccaagcgtcttacccattaatcaggaataacaatcttaggatgagaaggcaggaaattcaggttgacaaatctcttagtagagtatccatgtttcttttctgttgcatcattctttgtcttctcttgttttg

SEQ ID NO: 16151 - DNA, 868 bp, Gossypium raimondii
  Predicted polypeptide sequence is orthologous to G1535
ttttgagggatgaacgccgccgagctcagccgtttgtgctatcaaatgggaatgccttacatgaagtggctccttttgctaatggttcccatcctggaaattgcatttcactccttagaatcaacgtttccagcaactcatcacaacacgtagacctaatgctacaagagagctgcaccaacaaatccggcagcctcgtcgtgtactcaaccgtagacgtcgattccgttcagctggcgatgagcggcgaggacccgtcgtgtatcccattgcttccgttaggcttttttataaccccaatggaactggtgaatgatggtgggtgtaaggacgaagcaaatgggcataatattacagcagggagtttactcaccgttggacttcaagttctagccagcacaataccatcggcaaagatcaatctgtcgagcattgcagccattaacaatcatttatgcaccaccgttcaacaaatcagtagtgctttgagtagcaattgcatcgggtcttgcaatgaaggtgacaatggtaaagaaaaatagggtgttggtgattcgtgaattacccataacatccttaattttgttaactaattgaggaagttattggtaattgtactgaaaatcgtgcactgggatttgtagtaattttaatgtggtaaataaagagtgtaatgatgatggagggttaaatttgaaaacttgggggggtataggtgaagtcaagagcgcaccaattgtgaccctttgcttttaatggtaaaggccaccaattagcaagggtgggtggttcgggtattgacttcagctttcttgccctttttttggtaatttttatatatagttataataaacctaagtatttgact

SEQ ID NO: 16152 - DNA, 888 bp, Gossypium raimondii
  Predicted polypeptide sequence is orthologous to G1835
ttttgttattgcagtatgaagatattgttccattggaatggatgtcaaaatttgttgaagatactcagtgtggagcaagcttgacaactaagaaagaagattcctcttcaatcagtgagggatccaatcatcaattccagacttgcagtccggtttcggttcttgaaagtagcagctcgtgttcaggaatgaaaccattgcctcgcagtcctgaaacgtctgcccctgggaaacgcggacgtccacgaagcaaacgtcctcgtctggccactttcaatcatcatccaggagttcagatgacctccccagcttcatctgtcaatgagaacgacattccccagccatttgctgtcccgaaggtgctgtcggattctgagaactatgctgagtcacggcttctgatcaaattaccgaaacaagtcaatccagaacataagaagaagaagttatcggtttcagctgcagcaggcattgctgattatagtcaaaatccaactggacaagccgttaggaaatgtatgcactgtgagataactaagacacctcaatggagggcagggccaatgggtccgaaaaccctttgcaatgcctgtggtgtccgatacaagtctggcaggctcttccccgagtaccggcctgctgcaagtccgacatttgttccgtcagtacactcaaattctcacaagaaagtgctggagatgagaaccaaaagttgtgcactagcgcccaccacaacaatggctgccaacaatttaccagagttgattccaaataaaagcaacccagcattggattatatatgagtgtcttactccgtacacatccaatcatgagtatggaaagtgttggaaaaaacgaaggtagtatatcggatacatacttttatcc

SEQ ID NO: 16153 - DNA, 884 bp, Gossypium raimondii
  Predicted polypeptide sequence is orthologous to G1852
cgggaacacagtcatttggaaaaagcctgtatggagattcgtgtctgccaaaccaaaatgaatttgggcttgaatcttgtgatgaatcaaatgaccccagtaatgcatggtactttaagttaagaagatgcgtgacgtcaacgtcttctgtgaatggtgaacatcctgttgggattattccgaagtggccagacaggctaacaagagctccttcaagggccttggtcgtgaaaaacgggattgatttgtttcgggcagacacaaggaggtggacaaggagagttgcctattataagaatactctgaatctgaagcttgggagtccagcagtacgcaatgtcatggacatgaatgcattttttggaggttttgcagcagcacttgtatcagatccagtatgggtgatgaatgttgttcctgctcggaagccattaactcttggtgtaatatatgacagaggccttattggagtataccatgattggtgtgaacctttctcaacatacccacgtacttacgattttattcatgtagctggcattgaatcactaataaagcttcctggttcaagcaagagcaggtgtaaccttgtggacctaatggtggagatggatcgcatgttgcgtcctgaaggaacagttgtgattcgagattcacctgaagtaatcgacaaagtggcacgcatagctcacgcagtaaggtggacggctaccataaatgacaaggaacctgaatcacatgggagagagaaaatcctggtagcaacaaaaaccttttggaagctaacttcatcccattgagacagacttgttctttataatgtaggtatttttcttttcgtttcaatttttttattatctggagccaagttgtcttcctcatgc

SEQ ID NO: 16154 - DNA, 837 bp, Gossypium raimondii
  Predicted polypeptide sequence is orthologous to G2124
gggatcaagtcgttgactggttgcttaatgctcgcttacatgaaatcgatgaactcccacctctgccgatgcccccaccgccggcgaactttccgatttccgatgcattttggaggactaaatcgaaagaagttacgagggatgtaatcgatgataaagatgataaacatagaagaaatgaaggtgatgatgatgatgatcatgggacacaacatgtatcatctggttcatattatcatttcgagccttctaattttcctttatcatcacatttagtaagccatggatttgcagtgcatgcgccccaggttgataatttcaacgttgtggcagcaccattgccatcagcattatcactatgtccattaccaccgccgcagccaggaggcggagcaccaccattgtttccgcctcatgtggtggatcctagacaacaagttaaccattttcagatgctgagttcaggtgcacaacagaacctcttgcttaattctctcaactttccaccgataacccaatcttttagacccttccaattgatgcctcctaggtttccccataatcaaccagataaatgaccaaaaagaaaatcaaatatcatatggggaaaaatatagtgttaatttgaatctatttacataattgcaaggcattatgggggagatgatgaaattcaagtgtgttttagattatcatgatgggcttaataatattaccaaaattccctagtataggatataatttcaatacacattcagccagaaatgtaagttttgtaccacttttcttagggctttgtgtttggtttttgcttcattttgggtggtttggaaaaat

SEQ ID NO: 16155 - DNA, 794 bp, Gossypium raimondii
  Predicted polypeptide sequence is orthologous to G2144
cgttttactcattcttctaagcttgaccttaccgccctccacgaatctaacccaactttctcgcttcacttctttaacctgttaacactgcaatttgggttgaactaaccaagtggctgctttttattttcctgaattttgaacgtgggtattttcacacttcccaaattgcctagtccccccgccctctaatggagtcgaaggcagggacgacggaaaccagatccaacataacggcgtcggacggggaccaagttgcggcactcgaatccctacaatttacagacgaattccaccgtttaatcttggctccgccatctgacaatgcgacttctctcacggctcttcttgaactcccggcttcacgagcccttgagcttcttcactctccggcttcggctaagcttatcgctgcttcggcttctagctttgaagctttaaaaggaaactttctttttccctctaataccactttgattgatcaagctgcgaggtcctctgtgtttgctggaggggttaacaacaccaataacaagagcaacgcgcctgaaacgacgtcgaacaatgcaaccttgaatcttgagaaagcagtgaagagtgagccggcggagaccgagtcatgtcagccgttggtttctgacccagcggtggagaagcggaatttcaagagaaaggatcgcgaaaagaaggctaaaggttcaacgaagaaaagcaaaactgcggcgaatgatagctcagatggccctgaaaagcttccctatgttcacgttagagctcgccggggagaagcaacg

SEQ ID NO: 16156 - DNA, 887 bp, Gossypium raimondii
  Predicted polypeptide sequence is orthologous to G2144
aagattgcagtatatgaatactcatgccatttaagtcagctcaagtcatgcggataagaggaaaagatcgtaatcggatgataatctacttcattccatggatttcagtgtcagattggaacatatggaaactgaagcttcgtttatacatgagcagctgcatcatgaatctagtagatcttacaggttttctaacagcgaagagaagattgaaaatgaggcatatggaaagaggcagcactatgaacatgattctgacctagctgatcgcctaactacagctgagaatgaggtcatttcaccatcatcatcaaaggttgttgatgatatggtcttcaacaagtatcttacagaagctagtggtcttcttaaagaagccaaagagtgtatgaagggaagacatgatgaagagcgtgtagaagtcatcttgaataggtctgcctcattactctcacaagccatctcaatgaagcccatgagcctattggctgtaggccagttaggcaatacatatcttcttcacggagaattgaaactacatgtcagtcgtgagttgaggactctttttactaaaaatgatcccataactcgtgagaggccgcaaggaagagtagttaacagactagatcaattttcatgcagagataaaattatttccctcttagttagtgcttgtgaggagtgtgaagatctccttgtgagagctgggcaaaaatatcagctggcattatcaattgatggagatgatgtgagatccctatataattggggtcttgctctgtcttttcgtgcgcagttgattgcagatataggaccagaggctgcgtatgatgctgataaactattcttggctgcaatcgataaatttgatgtcatgatgactaggg

SEQ ID NO: 16157 - DNA, 898 bp, Gossypium raimondii
  Predicted polypeptide sequence is orthologous to G2144
gggatcttgaatcgctacaatttaccgacgaaatccactgtttgatgtcggctccggcgaccgacaatgccagttccttcacggctttgcttgaactccctgctccccaagctgttcagcttattcactctccggattcggctaagctcattgccgctccagctccgaacgttgaagatttcaaaggcgggtttcatttcccttctaatggtgggctaattgaacgagcagccaggttctccgtgttcgccggcgaaggtaataacaagagcgactcgcctgaagcgacgtcgaacatttcaagtgcaaatctccagaaggcagtcaagagtgaaccggctgagaccgactcgtctcagccgttaatttccgatccaacggtggagaaccggggtatcaagagaaaagaccgagaaaaggtgaaagggcagacgaagaaaagcaaaacaacggtgaaagagagctccgacgacaccgagaagctgccttacgttcacgttagagctcgccggggacaagcaacggatagccatagcttagctgagagagcaaggagagagaagattaatgcacgtatgaagctcctacaggagttggtaccaggatgcaataagatttcgggcacagcgttagttttggatgaaatcatcaaccatgtgcagtccctacaacgtcaagtggagttcttatcaatgagactcgctgcagtgaacccaagagttgatttcaactttgatagtgtattcacggcagaaagtggattttttatggacagtaacttttctggcatggttatgcctatgatgtggcccgagattcaactttcagcaacctgtttgggggagagaagaagtctgcaataattacttaactccggagaacttgcttttaagctatg

SEQ ID NO: 16158 - DNA, 852 bp, Gossypium raimondii
  Predicted polypeptide sequence is orthologous to G2226
gtaaatgtttcatctttctagtccttttgagctttttttactttatggaatataagtggtgtataactctttttctttttttaagaagcctatcttatttcttggccataaactattaacaagatgccatttaaaaaagaaaaaaaaccatctttatcaatgttccactgatatcacatccaccagttgaattgcaggttaccagggtttagccattgtttttcatttgaagctctcctccccattgtttttaaggtcatatatttattatatattatcagcacaaaaagaaaaaaatgggtctctcaagtcttccatctccatcagaaggagtgttatgtatactcttggtaaacacagctttatctatatctatagttaaaggcataatccgatcgatccttcacgttgtcggtgtccatctcccaccaccatcatcggattacactgaaaatctctcggaatcattcgatttccaccttaatactcctgaaagttacatcgaggaattccggagtaggaccccaacaattcatttcggtgctgttttatgtagctgcaaacggcctcagcacgactgtcaggtttgtctgactcagtttgagccaaaatccgagattaaccacttgtcgtgtggccatctctttcacaaggtgtgtttggaaaaatggttggattattggaatattacatgccctctttgcaggactcccttgttgcctgaagaagaagcttcttgcttttggtaagaagattattaccaagtatattattatgcagagttgaggaattcccgtgtacagcgcggtatataaaaatatactgttatctttatcgagtgttgtcgttacc

SEQ ID NO: 16159 - DNA, 868 bp, Gossypium raimondii
  Predicted polypeptide sequence is orthologous to G2227
ctttgaataaaaagagctctttccttcctcccttaaagactcaaaccaaacatcgtaaaaggaaatatgttcactcttttcggaatttagtttccttttttcctcttttttgtaaaagtccccctctttttttgctttggtttattaaatctgtatggcagcaacgacgtcgtattggtgttaccaatgcaatcagttcttcttgatttccaacgaagatccgattacttgccccgactgtgacggcggattcatcgaagagatcgataacatgcctcatgcagcgcgtgctctccacgctgactcccgtctcgtcggcggcgatggattcaccgcgatgtacaatagctcaactacccttcgtcgaagccggatgaacggtggcgatcgttctccttttaatcccgtcatcgtcttggcgtcaccttccggggaaagtacaaatgttgaacagagtgggagggggtttgagctttattatgacgacggaggtggattgggtttgcggcctttaccggcgagcatgtcggagtttctgttaggtcctgggtttgaccggttaattgagcagttatcacaaatggaaatccaaaacattgggcgtcacaaccaaccgccggcgtcgaaatcggcggttgaggcaatgccaatggtggaaatagacgatacccatatccataacgaactgttctgtgcggtatgtaaagaacaattcgagttaggaaccaaagttttaaacatgccttgtaaccatttgtaccattcaaactgtttactcccttggcttcggttgcgaaattcatgccccgtttgcccgcatgaattgccggcagctaaaggggaagaaggggacgggagttcaaattca

SEQ ID NO: 16160 - DNA, 826 bp, Gossypium raimondii
  Predicted polypeptide sequence is orthologous to G2227
tttgcctttatttctggatctggaatcctcccctagggtcaagcatgtcttcaacgtcttcgtattggtgttacagctgcacccgtctggttcgggtggtggttttggatagcgggtcaaacgacgccgttgtctgcccgtactgcgacggaggcttcatcgaggagatcgaatcttcggataatcacaaccgtcggtttccagctatgtacatgatcaccagcaacgataatagccgtcaaaattcgaatcgggcgcgaaatctcgtctttcgtaggaatcgtcgtggttctgttgaccggtcaaacatcaatccgatcatcgtcctccgtggctccaccgacgacgagaacggctccaccaacgggaacagcaacatcaacagcgggtttgggttcttctatgatgacggatctgggtccggtttaagacccataccgacttcgatgtccgaatctctaatgggtttgggtttcgatcggttattggaacaactttcccagatcgaactaaccggactgggtcaacccgagaacccgccggcttcgaaatcggcaatcgaatcaatgccgacgattcaaatagaaaaggcccatgtttgttcggaaacccactgcgccgtttgtaaagaacctttcgagctcgggtcggaagcgaaggagatgccgtgcaagcatatttaccatgaagattgtatcatcccatggctggcgcttcgaaactcgtgcccactttgccgtcacgaattgccgtcggatcggagcgagtcgaacgacgaggcatcagagacggtggggctgagcatatggaggttaccgggtggggt

SEQ ID NO: 16161 - DNA, 880 bp, Gossypium raimondii
  Predicted polypeptide sequence is orthologous to G2239
gaaaacgaccgttacccttacgcccgcttttcccttccatggccatcatcgtggttgtcttgatttccgctttgttctttatgggttttttctctatttatcttcggaactgctccgaagccaacgccaacggaagcgtcgtccgccctttcaatggcgaaactgggcgttctcgccgtgggatgcgtgggcttgagccgtctgtgatcgagacttttcccaccatggtttactccgaagtgaaagttcataagatcgggaaaggagctttggagtgcgcagtttgcttgaacgagttcgaagatgaggaaacgctgcgtttaatccccaaatgcgaccacgttttccaccctgattgtatcgacgcttggttggcttctcatactacctgccccgtttgtagagctaatctcgctcctcaacccggtgaccctctgagccaacccgccgagttggataacaccaccaccgagttggacctcgaggctcagaaccacgacgatgactcagaactggaagaagaaaggaggataaatcctaataatattaactccgatgcggaggctcaagttgcaccggaagttgaagtaattgacttgaaccgaactttaaataggaaccggacacgcggatcaatatcaagccgaacacgtaagttctttttcctgcgatctcacacaaccggacactctttggtccaaccaggtgaaaacacagaccggttcactttgcgattaccggttgatgttcgaaaacagttaataaaccgaaagttaaatcgagcaacgagcttggtgttgcctagggaaagaagctcacggcgaggataccgaacccggagaagacggtggggggagtagtagaggaaagctttttcgat

SEQ ID NO: 16162 - DNA, 747 bp, Gossypium raimondii
  Predicted polypeptide sequence is orthologous to G2382
aaaacaaaacatctaggcacttggccattcattcaccttgaaaaaatgacgcatcagttaaactataacatggaatgggagtaatgatcttcactaaattcagtacaagtttctacttgattttgaatgataacagcatgtattccgtgttattattgtttatcacaacggcatttggcaacaggctcccatataccatacaacaacatttaacagccaaaatctgatgaatgttataaagaagataactgggttttgcatatattacccactagcattctcaccggaggcatcattcgcctcattctcaccatgctgtagttccgcaatttcagcctgggctctctccatgatctgcctcttctgcatttccaactccctgtgaaaatccattctcatcttctccaattccaacatctgctgccttttactattctcaattttttcatatatgtcgctgaatttctggatagaatctgcaagcaatttgactgaagaatcctcgccagattgcctcccaaatcttctctttttaggtggtagtccatctgagacatcctcctcactgtcagcgaattcagaattggctggactatccctcatttcatccaaaccatttgctcggttcaaataaactcgagggttcataaatacgtattcacccgagtcaaatccgcaagagagacgaccctgctgtggaggagttgacatcagcatatccatcttcttgaaataaacccatttgct

SEQ ID NO: 16163 - DNA, 819 bp, Gossypium raimondii
  Predicted polypeptide sequence is orthologous to G2520
aagcataaaaaagaatccccttaggaaacctcactgggaagttacttaagttcgcaactccttaggtctctttctaagccatcatagatacacagttcggtaatgagatcaaacacattagagacaacaagcaataaaccccatcatctttcttcgctaataatttaaccaaactttacctttttgctgggtgatggatccaccagctatgatgagcgatggggggtacaatctagcggagatctggcagtatcccgtgaatgaatctgggttaaggaggggtcagtttgggaatgtgccgccgcctcattacgaccaccccaatccagaggtatcgggtggtgtgaggagaaggcgtgatggagaagatgaggcagctaaggttgtctccaccagtagtggcaatggcgtgagttttggtgatggaaagagacttaaagcatcaggatgtagagaggagaatgacgattctaaagttgaagcagcagaacccagttcaggcaagccagtggaacaaaaagctaaaccaccagagccacctaaacaagactacatccatgtgcgagctagaaggggtcaagctactgatagtcacagtttagcagaaagggcgaggagagaaaagattagtgaaagaatgaaaattcttcaggatctggtccctggttgcaataaggtcattggcaaggctcttgttcttgatgagataatcaattacattcagtcactacagcgtcaggttgagttcttgtcaatgaagcttgaagcagttaattcaagaatgaatcctaccattgaagtatttcctcttaaagatta

SEQ ID NO: 16164 - DNA, 919 bp, Gossypium raimondii
  Predicted polypeptide sequence is orthologous to G2522
gttttcgctacttactttctctaactacttttcttcatttttttcatgtctagattcaaagtgctttgcttgtaaacgctaaatgcatctccttggtttgttttctggctcaattccctgatcttttgcatgcatctttgaattttaactatggaaaaccataaaatatgttctaagatctatatgcttttcagctggtttattttcacccaatttggagctcttttttggttaaaattttttgtttgaaagttgattttgaaggcatcattcaagtgtataggttattggaggtgaatgcatggatcgaacgggatgccatggcattatcagggtctgcatcttactatatgcaacaaagaggaataaccgggtcagggtccgaaccggagtctgggatacacggatctccaggcattcatccgttctctagtccaaatgtacaataccaatcaagtattccagtcactactgtgggatcaaccttagctatggagtctccatcaggaattgcccctcatagtgtcaatgtaggcacaccttcagcacagccatctagtgagacagtgaaacggaaaagaggaaggccccgaaagtacggtcctgatgggactgtttcgttggcgctgactcctgcatcagctcctcatccggtgaccacaacaccgggccaaaaacgaggaagagggcggccaccgggtaccggaaggaagcaacagttagcttcccttggtgactggctgtccggttcagctgggatgggttttactccacatgtcatcaccgttgcagtaggagaagacattgcaacaaagataatgtcgttttcacagcaagggcctagagcagtatgcattttgtcagccaacggggctgtctctactgtaactcttcttcagccatcatcttcaggtggcac

SEQ ID NO: 16165 - DNA, 785 bp, Gossypium raimondii
  Predicted polypeptide sequence is orthologous to G2565
tttcccagtcatcaagggatttagcatccctttcaccactagctccaaatcaactggtggaaagcagcaccggtgtcttggcatctgaggatcacaacaagaaaactaattggcaggaatgggcggatgatttgatcaatgttgtggatccagactggagtaagattcttgataataccaatgtcttaaaccccagagtggaggtgccaaaaccttctggagatatctcaaagcaacagcctcagtttcatcagaatcaacttgtgccacatggagaattttctagccatgcttacccatcatccactgctcctcctacaaagcctcgtatgcgttggacacctgagcttcatgaggcctttttggaagctgttaatcagctgggtggcagcgaacgagctactccgaaaggcatcttaaaacttatgaatgttgaaggcctaacaatctatcatgttaaaagtcatctgcagaaatatagaacggccagatacatgccagaaacatcagaaggaacatcagagaaaagaatcacttcaatcgaggaaatgaaatcgatagacttgaagacgagtataggaattactgaagcactgcgattgcaggtggaagttcagaagcagctccatgaacaacttgagattcagagaaatttgcagctacgaatcgaagaacaagggaggtatctgcaaatgatgtttgagaaacaaaaaaaggtggaggatgaaaaaggtggggttccctcttctgcctcggatgaccttcttgcaccattaccaggctca

SEQ ID NO: 16166 - DNA, 823 bp, Gossypium raimondii
  Predicted polypeptide sequence is orthologous to G2592, G2713
catggttatccagaatagccgctgggcgagccttccgccagagctgttgcgtgatgtgatcaagagattggaagcgagtgagagcaactggcctgctcgcaagcatgttgttgcttgtgctgcagtatgcaggtcatggagggaaatgtgcaaagaaattgttagatgtcccgagttctccgggaaaatcacctttccagtttctctgaagcagcctgggtcaagggatggaaccattcaatgcttcattaagagagacaaatctaatttaacttatcaccttttcctttgccttagtcctgctttgcttgttgaaaatgggaaatttcttctttctgcaaaacggacccgtagaactacttgcacagagtatgtaatctctatggatgcagataacatatccagatctagcagcacatacattggaaaactcaggtccaactttcttggtaccaaattcataatttatgacacacaacctccatacaacaatgctcagctttcaccacctggccgaagccgaaggttctattcgaaaaaagtctccccaaaggttcccaccggtagctacaacattgctcaggtttcatatgagctaaatgtcctaggtactaggggacctcgtaggatgcattgcagtatgtactcaattcctgcctcagctgttgagccaggtggcattgtccctggtcaaccggagcttatccctcgatcccttgaagactcatttaggagcatctctttctcaaagtcaattgacaactcatctgagtttagtagtgccagattctcagacattgttggaacccgtgatgaagaggat

SEQ ID NO: 16167 - DNA, 850 bp, Gossypium raimondii
  Predicted polypeptide sequence is orthologous to G2604
ctcagactctttctacccccatcgttcccctttgtgtctcacagttgaactgtatgggagaaagcttgctgctctctggttctagacagtgaactattgaaaggagagtttagctctgtctgattttacaatgccagttccccttgcgccatatcccacacctccagcaccctacactcctcctgctgccaatgggtatggctttggcattaagatacacaggttgttatggatgtaaagtaccaatattacaagtctagtttggcttctaaaaagcttggcctcatcaacaaattggtcaaagacaggagaatttatgaattaagtcattaacctttctgcatctacaaaagttactgtatttctactctcttttttttttttttttaccttccattgacaactgatctagtggccaaacctatgctaaccaggtgctcaaagccaacttgtgtgttccggttgtcgaaatttattgctctatccagttggagcaacctctgtgtgttgtgctgtttgcaatgcagtaacagcagtgccgcctcccggcacagaaatggcacagttgtttgcggaggctgtcataccttattaatgtacatccgcggagcaacaagcgttcaatgttcgtgttgtcacactgtcaatctggccttggaagcaaatcaggtggcacatgtaaattgtgggaactgcaggatgttactaatgtaccagtatggagcgagatccgtaaaatgtgcagtttgcaattttgtgacatcagttgggggctcagctagtgctgctgaacagaagttcaacagctgagactatattagaccccaagtcaaatattaaaagcaacaag

SEQ ID NO: 16168 - DNA, 945 bp, Gossypium raimondii
  misc_feature (875)..(875): n is a, c, g, or t
  Predicted polypeptide sequence is orthologous to G2783
caaactggagaggttgcttctgtaaaacctttcagcaacaagcaaaccggtcaagtggagggctatggctttaatgagtttgtttcaagagctgctgctgagagagttttacaaacatacaatggtacacctatgccaaacggtgagagcaactataggttgaactgggcatcctttagttcaggcgataggcgagatgagacccctgagttcacaatctttgttggagacttggctgctgatgttacagattacatgcttcaagagaccttcagggcacactttccttcggtgaagggtgcaaaggttgtgattgataggatcactgggcgcacaaaaggttatgggtttgtcaggtttggcgatgaaactgaatataatcgtgccatgactgagatgaatggtgctttttgttcaactaggcctatgcgcatagggccggctactaacaagaagactggtgctgcacagcaatatccagcagcttcatctcaagggactcagaacgagaatgatccaaataatacaactatatttgttggtaatttggattctaacgtgactgaagaccatttgagagaggtattcagcccatatggtcagttggtgcatgtgaagattccacaaaacaagcgttgtggatttgttcaatttgctgataggagttgtgccgaagaagctctccgaatattgaacgggactcagttgggtggacaaagtattcggctttcatggggtcgtagcacatcaaacaagcaggcccaagcagatccaaaccagtggaacgctggatattatggatacagccaaggatatggttacggctatggcgctgccccacaagaccccaacatgtactatggagggtatcctgngtacggaaattatcaacagccgcagcaacagcaacaagtcggatatagctaagtgctgatattaactgtc

SEQ ID NO: 16169 - DNA, 814 bp, Gossypium raimondii
  Predicted polypeptide sequence is orthologous to G2854
caatctcttctcctcgtctatcgaatccgttgaaacaaccaccagcaggaggtgtagctccgccgccgcccatggcagccgatccgtctcaaacccagcagtaccagaaacaacagcagtcgcagccgtggatgatgatgtctcaacaacagcaggcgggtcagccagttcctccacctgcaggttggaatccgcaacccgtccctccgccctctcagatgcagcagtactccgctggttccgcgaccgtcggatccggcgaaattcggtctctctggatcggtgatcttcaaccgtggatggatgagaattacctcatgagtatcttcgctcaaactggagaggtggtttcagctaaggtgattagaaataagcaaacggcactgccagagggatatgggtttatcgagtttgtatcacgtgctgcagccgagagggttttgcagttgtataatggggtgccaatgccaaattctgagcagaattttaggttgaattgggcggctcttggatatggagaaaagaggcaagaagagggtcccgattacacaatttttgttggggatttagctgcagatgtttctgattacatgttacaagagacttttaaagctgtttacccatctgttaagagtgccaaagtggttactgataggactacaggccggtctaaaggttatggctttgtaaagtttggtgatgaaactgaacaaattcgtgcaatgactgaaatgaatgggatttattgttcaactagggcaatgcggattggaccagctgctaataagaagcctgtcactgatcagcagtatca

SEQ ID NO: 16170 - DNA, 769 bp, Gossypium raimondii
  Predicted polypeptide sequence is orthologous to G2981, G2982
aactaacattcgttaaaaaaaaaacattaaaaaacctaacatgtaatccctaaactcaaaatatgggtatgtggacctgtcgattgaaaattccaccttcattcccccatacccaatattacacttctcaaaagcctaacaacaaaaactaaacccttacacaaataaaatttccctcttttccacaaccttccttcaaacctctccaagccttgaaaccccctctggctccaattttccacaataaaaacctcctctttcctcacttccaaagtgattttcttttttattttttttatttgaagtcatagaaacaaacagatagaaataatatattattttgggttggaagctactattactgattatcctcattaacatttcttgatgtcaagcacccatttttcattaaggtatggtaagtggtagtaaccatattcaaaaccataaccaccatgaaaatggggagaaaaacccaactttgggaggagcttctaggtcgtggggcacgaccgtttccggtcaatccgtttcgactagtggtagtgttggctctccctcgagccggagcgagcaagctatggctacaccagctagtgagaatactttcttaagattgaaccatctcgatattcacggagatgatgctggatctcaaggtgccgttggtaaaaagaagaagagaggtcaacgtgcagttgcaggtgataagagtggcagagggctccgccaatttagcatgaaagtttgtgaaaaggtggaaagcaag

SEQ ID NO: 16171 - DNA, 870 bp, Gossypium raimondii
  Predicted polypeptide sequence is orthologous to G2998, G2999
gtatccttaaccctaaactccaaccccccacctccaaattcctttccctcgtttctctttgcttctccctcgctaattacagatgtttacaccctgcttagatggtgtggtaatggcgtaaaagcggtggcctgactctgccgtttcctcatctctttcttaaaactctcgttgaaatttggggtatgggtcgagggattttggcaccataatgctgaatacatgaatatctgaggaggaggaggaggaagagataagggaaaccaaccatatatcctagataagctacgtacttgcatcttctcttttatgaaatgcttcaagttgcacacaaaagcacgggaaaacaaatctattattagttgaactttgagcttgtttagcttggataaaatatcataaaaaagtttgcttcttttttttgtttttcaaccaactactccttaaattatggaagtgagaggccaagaacatgatattaaaacgccagggtcttcagcctttggtcttcactcgcctggagtagagagaagaaaagatgggaaccataatggtacggccgttctcacttgcactcaaaccctagatcatgttcatcatctccagaggcagcaatcactcggtcaagggagatccccacatccggatcgagtcgctgccgccactggtgctgcagctgttgctcccatttcagttggttcaaacgcaaagccgtccaacttcgtcagataccgagagtgtctcaagaaccatgccgccagcatcggcgggaatgtgtacgatggctgcggcgagttcatgcctagtggtgaagaaggaacactcgaggccttgaaatgtgctgcctgtgactgtcatcgcaactttcat

SEQ ID NO: 16172 - DNA, 839 bp, Gossypium raimondii
  Predicted polypeptide sequence is orthologous to G3091
ctgaaacgttaaaacagactcgttaccctttgagttttcccctgttgttttctttcaattacttcaagctggcgatcgataatcaagaacccactgtccgtgaaatcaagcccaagaacagaagaatcatggtatctccattctcaaaaaatccatctcttttttctcttctttctttttatgttggattcttgatctgggtattcatttgaaatgtgtgttaatgaaatgttggttttgacagggagctggtgggcctgatgaagaagacaacaggtggcctccatggctgaaacctttgttaagagagcatttctttgttcaatgcaagcttcatgctgattctcacaagagcgaatgcaatatgtactgcttagattgcatgaacggcgctctctgttctttctgcttagcttatcacaaggatcatcgttacattcagattaggaggtcttcataccatgatgtgataagggtatctgagatacagaaatacctggacatatctggaatccagacttatgttatcaacagtgctaaggttgttttcatcaatgagaggcctcagccaaggcctggaaaaggtgtcaccaatacctgtgaggtctgtgaccgtagccttgtcgactcatttcgcttctgctctcttggttgcaagattgttggcacatccaagaatttccagaagaagaagagacacttggccatggcctcagattctgaggattcatacagcagcagcagtagccatggaaagcttatgaacaacaacaacaaaatgcgaagctttagtccttcgacaccgcctccaacttcagtgaattcccgaactgcgaaac

SEQ ID NO: 16173 - DNA, 881 bp, Gossypium raimondii
  Predicted polypeptide sequence is orthologous to G3967
cttggttacaagcggaaatactcatttcattgctaaaaatgttcaagctaaacccaatcatacaaaactaaatggatcttctatcgagtatggacatggtatcgactcagctattcatcatactcgcagaatcttagcgattttagaggcactcttttcactgaagccgtcttctgttggcacctcatggacttatagttcgaatgaaatagttgctgcagctatggttgccgctcatgtttctgaactatttagacagtcaaaggcttgtatgcatgcgctctctgtcctaatgcgatgcaagtgggacaatgaaatttacactagggcatcatcgttatacaatctcattgacattcacagcaaggcagttgcatccattgttgacaaggctgaaccattagaagcacaattgatatatgcacctgtttgtttagatagcagaacacgaagcaaacgtacaaataccgcttgctgtgatcctcctcgagtatcttcttcagaatatgaagattcaattcatccagccaataatctcagatgtcagatggtgttaacatcagatgaaggcttaggaaattccacgggcaaaagtgtagaaagtttcccgttagatgcctcggatttggccaattttcttacaaaggataggcacttaggattcaattgcagtgcacaaattcttctaagatccttgcttgtggagaagcaagagttatgtttctctgttgtttcactattgtggcacaaactgatagcagcccctgaaacacaacccagtgccgaaagcacttctgccccacagggatggagacaggtggttgatgcattgtgcaatgtcgtatcagcatctccggcaaaagcagcaactgcagttgttc

SEQ ID NO: 16174 - DNA, 868 bp, Gossypium raimondii
  Predicted polypeptide sequence is orthologous to G3967
atggaattgcagccatggattgccaaaaacgatgatcaaggtcagaagatgtggagaatcaaccagcggattgtaaagttgatagtggaactaatgagaaatcatgatatcccggaatcattggtaattgtagcaagtgcctctgatttgcttctacgtgccactgatggaatgctcgtagatggggaagcttgcactttaccacaactcgagctgttggaagcaacagctagagcagttcagccagtactagagtggggggaatcaggactggctgtcgtggatggactttcaaacctgttaaagtgtcgtctgccagctacaactcgatgtctttctcatccaagtgcacacgttcgtgctctcagcatatcggtacttcgcaatattctgcaatcaaatcctaagctggaaataaatggtatccatggtccttatttcagtatcagtgtcatcgattggcatactgatatcgagaagtgcttaacatgggaagctcatagtcaacttgcaagaggaatgcctatacattttctcgacaccgccgccaaagaactaggctgtaatatttcgatgtaacatgaattaaccttcgaatccttttcaggtccgactacatagaggaatataatagaactttctcccaagtgggttgaactgaaggatatggggatgaagcctttgaaggttgtgaaaagcatgcaatacaaggactctgccacaccaaggttttatgtcactaatcttactttgactataaattagctttgttatattataggccaagattcccatttgtttgagggattacagtatgtaatttcagttaacttctatggtttcaatcagttgtatttggatagtttag

SEQ ID NO: 16175 - DNA, 575 bp, Malus x domestica
  Predicted polypeptide sequence is orthologous to G28, G22, G1006
cttctcaattccacacacacacacacactctctctctcttcttttttgttagcctagtcatccaaattaaggacaaagctaacaagcaaagatggaagaacaacctcagcactacacaagctgctgctcattgacggtgaacaatattagcagtccatgtatgatgccgtgcttaacgcaacaatggggagatttacccttccaagtcgacaattccgaggacatgatcgtctacaactccgttcatgatgctcttagcctgggatggtctcccgaccacactttacccttccaagtcgacgattgggatgacatgatcgactacaactcccttcacgacgctcttagccccggatggtctaccgaccactcctgggaatgtgtgaaacccgaacagacgtatgatcttgatcatgtttttggacaaagtcatgatcagctgccacctgatgtttgcactcaatgtgaaccccacgattgtaatgttcccattaatggaaacgaaccctgaccaaccctagtactgccacctgatactgatattgctacgatggatcatgacgatcgtgatcaaa

SEQ ID NO: 16176 - DNA, 452 bp, Malus x domestica
  Predicted polypeptide sequence is orthologous to G481, G482, G485, G1364, G2345
ttttttttttgaccgcagaagcatactttgtcattcaactcagattcaaatacatcatactatcagtattaaaacttaacaactttaccaccttcgagttcttaaaaatgatatgtgacaaaattaaaaacttctactcattgcttcgcgtggaatgaacaacgagatgctgtgccgggattgcaaggtatcatggaacccatcatcaagatcaattgcacattgaccacaagccatgttcactcgcaaaagcgtcaatttccatttcccatattattcaagggcacataataatcctcttgagggttgccatagttcaatgctccctgatggacaaactgtgaacttgggccaggcattgctggaacagcattccctttaaaagaaccatctccacccctagctgagccctttgcatcaccctcagtctccctgtacctactcaagtaaat

SEQ ID NO: 16177 - DNA, 660 bp, Malus x domestica
  Predicted polypeptide sequence is orthologous to G481, G482, G485, G1364, G2345
gtatacagtgaatcgttgtgagtaatggcggaggcaccgacgagtccggcgggcgggagccatgagagcggcggcgagcagagcccccagggaggaggaggaggaggaggcggtagcggcgtcagggagcaggatagatatttgccaatcgccaacatcagtcgcatcatgaagaaggctctgccgaccaacggcaagatcgccaaggacgccaaggacaccgtccaggaatgcgtctccgaattcattagcttcgtcaccagcgaggccagcgataagtgccagaaggagaagcggaagaccatcaacggcgacgatttgttgtgggcgatggccacgttagggtttgaggactatatcgagcccctcaggatttacttggctaggtacagggagacagagggtgatgcaaaggggtctgctaggggtggagatggttcttcgaaagggaatgctgttccagcaatgcctggcccaagtgcacagtttgttcatcagggagcattgaattatggcaaccctcaagaggattattatgtgccattgaacaatatgggtaatggaagttgatgcttttgcgagtgatatgaggaagaagagaggacatggattgtggtcaatgtgcaattgatcttgatgatgtgttcctcgatatcttgc

SEQ ID NO: 16178 - DNA, 726 bp, Malus x domestica
  Predicted polypeptide sequence is orthologous to G867, G9, G993, G1930
cgttgctgtcgagccctcatccgccgaacccatttcctccgacgacgaagaaaacgacgacgccgaggccgcgtttctgagctcccactctaagtccgaaatcgtcgacatgctgcgaaagcacacttacaatgacgagctggaacagagcaagcgcaacaactccgcttatgggaagcggtctcggtccaacggatcactgggcctgttcggtacggacaacagtggagtcccgaaagcgcgtgagcagcttttcgaaaaagccgtgaccccgagcgatgtcgggaaactgaaccgcctcgtgatcccgaagcagcacgcggaaaagcactttcctttgcaaagcggaagcgctgcaaccttaacggtaagcgcttctaccgcttgcaaaggagtgcttttgaattttgaggatgtcgggggcaaagtgtggaggtttcggtactcttactggaacagcagtcaaagctacgtgttgaccaaagggtggagccggttcgtgaaggagaagaatctgatggccggggacattgtgagctttcagaggtcgaccggaccggacaagcagctgtacattgattggaaggccaggatgagtgtgaataataccaacaataatgggtcaagcccggttccgatggttcggctatttggggtcaacatattcaaaaatacctgggagcagcgggcccgggtcagcggatgcagctgcagctgctgctatcg

SEQ ID NO: 16179 - DNA, 763 bp, Malus x domestica
  Predicted polypeptide sequence is orthologous to G867, G9, G993, G1930
ttttttttttttttttttcaaattaatttgttgcacctaatttcaaaagctttgctttcttcagctcagcttttttctttttgtcatctaatatacatttcacctttcttgcagcttcacagaatgctaaaaaaaacaaagaaaaattttaaaaatgctacaaagctccgatgatcctaggcttcttgctaaactctaatttcaaaaactccatctctctcattcttttgccgatattattattgcaaccgccgccaatagcagcggcagctgcagcatccactgggccagccccgctactcccaggtattttgaatatgttgaccccaaatagccgaaccatctgaaccggtgcaagctgaccttgaaccgggttcgacccattactgttattatacacactcatcctggtcttccaatcaatatacagatgtttgtccggtccggttgacctctgaaagctcacaatgtccccggccttcaaattcttctccttcacgaaccggctccatcctttggtcaacacgtagctttgactgctgttccagtaagagtatcgaaacctccacacttttcccccgacatcctcaaaattcaaaagcactcctttgcaagcggaagatgcacttaccgttatggttgcagtgcttccgctttgcaacggaaagtgcttttcggcgtggcgcttcgggataacaaggcggttcaccttcccaacatccctgggggtcacgggttttttcaaaaactgctcacgcgcttt

SEQ ID NO: 16180 - DNA, 467 bp, Malus x domestica
  Predicted polypeptide sequence is orthologous to G867, G9, G993, G1930
tttaaagcaccttcttatctgtcattctatctctctgtctctctctctcctctccaccttcgaacacacaacatacataatcaacgaaacaagaacaatggatggagtaagtagcacagaagagagcacaaccagtgactccatatccatttcgccaccccatcatattgttacacgtgtggagccacttgccaagtcagcgccccaagtggacagcctctgccgcgtcggcagcggggccagcagcgtgattctcgactccgacctcagcagcggcggcggcggcactggtggcgtggaggccgagtcccggaagctcccttcctccaagtacaaaggcgtggtcccacagcccaacggccgttggggggcccagatttacgagaagcaccagcgcgtctggctgggcaccttcaacgaagaggacgaggccgctacggcctacgacgttgctgcacagcgcttcc

SEQ ID NO: 16181 - DNA, 661 bp, Malus x domestica
  Predicted polypeptide sequence is orthologous to G1988
ccaaatcgtctcgagacttcgattcctcctctacgctccgcaggaaatcgagaaatgaagaaagtttacagggcttgcgagctctgcgaccaggaagcctctttctactgcccctccgactccgccttcctctgctcccgctgcgacgcccgcgtccaccaggccaacttcctcgtcgcccgccacctccgccagcctctctgctccaactgcaaatctgttgcaggaacccgcgatctccactctctctgctcctcctgctcgcctgaatttttttccggtgactgcgacggcgacgccaagtcgtcttcgtcgtcggattgttccgcctgcatatccagcacagaaatggggaccacaaagaccgggtatgagaatcggaaatccgagagctccgtgacggatgtttccggttcgaatgttccgtacaaattctcaggcatgaagaggaatatcctgcccaaattctccggcgccaggaggaataatagcgtaaggagggcgcgagcgcgaacttcgaggagcgtggatgcgaaagcggagggcagtttcgtaaattggtgtaagaggcttggggtgaatggtaatttggcggaatcggtggtttcgaccgcgtcaaatgcgtttggattttgcctggagcggttggcgagtgtgcctc

SEQ ID NO: 16182 - DNA, 644 bp, Malus x domestica
  Predicted polypeptide sequence is orthologous to G2
cttcaatctcaagtcccagctgaaatgcataaatatgggcagttcagtagtaggaggcctactgccgaagacattcaaatgcctcacaatttcccaccacatttcaactcaccaaattatcatcatattcagtttccgagcagcagtgaaggagggggccgcattggcagtgatctttcactgtcaatgagcgaccaccaccaacaatggcaatccgctactccgacctccgatttatttgcaactgctgcagcatcatcaggattcccaccacaaattagaccgtcgtacacacaaaacggctggctgcagaaaaatgggttccactctctcaccagacgctaattaaagctagcttagctctctttggtcatgaccccttttaatcaagatttttctgcctaattaccaccatcatcccccacctccccgattctaatttattacgatcaagtcctcttgattctgtttattttgtaagcaccaaaaatccagttctttcagtgctccaaaacatagacaaattttagtaacaaggacaggaaattctcctattttttggagaaatgaaatcaaatgtatgctctcattggtgtttaccaaaacaaaaaaagaacaatacttgactatttaaagatgagtag

SEQ ID NO: 16183 - DNA, 2234 bp, Malus x domestica
  Predicted polypeptide sequence is orthologous to G2
ggcagtttagtcgccactccaacacaagatcctgcatcacctccactctctctctctctagctccatagctcgtccttatagctctcctctctttctctctctaacttttttcctcttcggggagtttccttgttcaagttgatgcctttttgccacgctgaattctgagtttgatgtaaaaaacgaaaccgacacttaaccagacagctggtaggcaagcgagagacagggaagataaaaaaaaaatgtgggatctcaatgactcgcctgatcagcggccacgtggcgaggaatctgaaggctgctcctcccagaagacctccgccgacggagacgaggaaaagaggaaacgggtcggatccgtgtccaattcaagctcgtcggcggtggtcatcgaggaggacggatcagaccaagaggaagatcaggacgacgggcccaccaagctggccaagaagcaaggaggaggtgggggaaagatattcgggttctccgtggcccacgaggagtccatggatagtgatccgcccgcgaccgtcaccagacagttctttccggtagagctagactattcctcctcctctaatcttgacgtaatggggcccgcagagggcggcggtagcatcccaccacctccttctacatcgtcgtcgtttccccgagcccactgggttggggtcaatttcgggcagtcggattcgggcagccccggaaatccgccgcccgccggggaggcctcccaccagcccatgaagaagagccggcgtgggccccgctccaggaactcccagtaccggggtgttacgttttaccggaggactggccgttgggagtctcatatttgggattgtgggaagcaagtttatcttggtggatttgacacagcgcatgcagctgctcgggcgtacgacagggcggcgatcgagttccggggagtggaggcggacataaattttagcatagaggattatgaagaagacttgaagcagatgaggaatttaacgaaggaggaatttgtgcatgtacttcgccgacaaagcaccgggttcccgagagggagctctaaatatagaggggtcaccttgcacaagtgtggcagatgggaggccaggatgggccaatttttaggcaaaacatacgtttatctgggattgtttgacactgaggttgacgctgcaagggcttatgacaaagcagcaatcaagtgtaatggcaaagaagctgtcacaaactttgatcccagcatctacgataacgaactcaactcctctgaatcatcgggtgttattgctgcggatcacaatctcgatttgagtttgggtagcacaaactcaaagaaaaacaatcaagcattagggaatgatcatcatagccaaaatgttgcaatggaacaccagcattctgtctcgatgcaacttgatgccaattggaggagtcaaggacttcggcctaagcttaacatacaacgagatcgatcaagagacgacattgatgctcagagaagagacgggtactcggagagtgaagccatgcagcttctactccgaacaaaccttcaatctcaagccccagctgaagtacataaatatgggcagttcaacaggaggcttactgctggagacattcaaatgtctcacaatttcccaccaaatttcaactcaccaaattatcatcatattcagtttccgagcagcagcgaaggaggcggccgcattggcagtgatctttcactgtcaacgagcgaccaccaacaacaatggcaatccgcaactccgacctccaatttatttgcaaccgctgcagcatcatcaggattcccaccacaacttagaccgttgcccacgcaaaacagctggctgcagaaaaatgggttccacactctcgccagacgctaattacgctagcttagctctttgatcatgacctcttaatcaagatttttctgcatctccacgtccccgattcttgttaattacgatcagtcctcttgattatgtttattttgtaagcaccaaatcggcaagtctagttctttcagagccccaagtcaaagattttagaacaaggacgggaaattctcctagtttgtgggaaatgaaatcaaatgcatgctctctttggtgttttaccaaaaacaaaatgtatggtcattttgtccaactaacaaatgaatggagtagatcttcaactagattttctgattctgacgacaaaaaaaaaaaaaaaaaaaaaa

SEQ ID NO: 16184 - DNA, 582 bp, Malus x domestica
  Predicted polypeptide sequence is orthologous to G4
gacgaggacgatgaaatggttgatttcaagccctctgctttctctgccggaaacccctcttttgctcgtggttctaccgctgtgaaatctgtggagtttgatgggcaagctgagaaatctgcaaagataaaaaggaagaaccagtacaggggaattcaccagcgcccatggggtaagtgggctgcagagatccgagacccaaggaaaggggttcgggtttggcttggaacattcaacactgcacaagaagctgcaagggcgtatgatgccgaggcacgtagaattcgcggcaagaaagcgaaggttaatttccctgaacaaactccttgtgcttctgcaaagcgttccatcaaggaaaatcctcacaaattgatagccaagacaaacttgaatggcactcactctaatctgaaccacaatttcaattttgtgaacgactcaagtgaggactactacagtgctctgggttttctggatgaccacccccccctgaataactttccatacctgtcccccttccctgccaatgaagatgttgcacctgactcctctgtctcatcaccacatgcccctctttttttc

SEQ ID NO: 16185 - DNA, 682 bp, Malus x domestica
  Predicted polypeptide sequence is orthologous to G4
acccaacaaagaagatgaagcctaactcacaggatctggagcctcctgaggataattcgggaaagacactgtctgatgagctctcagcttttgagatgaagtactttcagaccccatatctcgatgagagctgggatgcttcagtggacgcgttcctcaacggtgacgcaactcaggatggtggtaatccaatggacctttggagctttgatgatctgcccgcaattgttgggggagttttttaagcgatgaacctttccccacctttctagtttatgtaaataaagctacatgttagtgagtttttcagtcctctgtgagcttctacattgtttcattattggtctcgtgttcgctcccattttctccagaaagagttgtcggtttcctttacttgtgcttgcaggatgtgtttcgggttggagtgcaactgtgtaggctgttgaacatgcataaggcctgtgcggggagtattttaagccgtagctaatgtcatatggagagcgtataggtattaggtttactttcacctccaaagagcttgaacttgtggtttctcaactttgatgtttgtattgatgaaattgtgtgagctatgatggaatactgaaacctcataaatctgtacttgtttaaatttattcaggtcttttcttttacaaaaaaaaaaaaaaaaatgcgt

SEQ ID NO: 16186 - DNA, 748 bp, Malus x domestica
  Predicted polypeptide sequence is orthologous to G4
gaattccgttgctgtcgaccagtacaggggaattcgccagcgcccatggggaaagtgggctgcagagatccgcgacccaaggaaaggggttcgggtttggcttggaactttcaacactgcagaagaagctgcaagggcatatgatgccgaggcacgcagaattcgtggtaagaaagccaaggttaacttccctgaagaaacccctcgtgcttctgcaaagcgttctgtgaaggcaaattctcagaaactgatacccaagacaaacgtgaatggcactgagtctaatctgaaccagaatttcaattttgtgaacgactcaagtcaggactattacagtgctctgggttttctggatgaaaagccaacattgaataactttgggtatatgtctaccttccttgccaatggagatgttgcactgaaatcctctactccatccgatcctgcccccttttatttgagttccgatcagggaagcaactcatttgattgttctgacttcggctggggagaacaaggctcaaagactccagaaatctcatcagttctttcttctgtgatggaagaaactgatgactcactgtttctcgaggatgctaacccaacgaagaagctgaagcccaactcacaggatctggtgcttcctcaggataatgcaggaaagacactgtctgatgagctctcagcttttgagatgaagtactttcagaccccatatcttgatggggagctggggatgctttcagtg

SEQ ID NO: 16187 - DNA, 619 bp, Malus x domestica
  Predicted polypeptide sequence is orthologous to G5, G974
cgatttatctgatctcttgagggaagatcagctcatgaaagcacttatgccttttatgaaaagtgcttcttcaacatctccttccacttcttacacttaccctcctcagaacaaccaaaacttcaacttgtaccctgacttctgctcagcacctatgatttcacaagcaggtgttatagggcttaaccaacttaccccatctcaaattcttgaaatccaatcccaaatggtcctccaacaacaccaacaaaagcaacagatttctgcttttgcttcttcagctgcttaccttaagctgcttagtacaaatgcactcccaatgaagaaagctggcactccctccaaaccgacaaagctctacaggggagtgaggcagaggcactggggcaaatgggttgctgagattagactccccaggaaccgaacacgtctttggcttggtacatttgacaccgctgaagaagctgctttggcttatgataaagccgcttttaagctccggggagactttgcttgccttcatttcccccatcttaagcaccaaagggctcatgactccggcgcctttggccattacaagccccttcattcctccgtcgatgcgaagcttcaagaaatt

SEQ ID NO: 16188 - DNA, 513 bp, Malus x domestica
  Predicted polypeptide sequence is orthologous to G5, G974
tcgacaccaagcttcaagccatctgcgaaggcttggccgaaactcataaacagggcaaggcagcgaagcccgccaagaggtcatccgctgcaacgagccgacagccggccccgaagactttggccgtcaaggttgaaacctcgtcgccggtgattactgatagcgaggggtctgccgggtcttcgccgctttccgatctgactttcggcgactctacggagccgtgggagaacagcggcgcttccgagagcactgccgtgttagagaagtacccgtccgagattgattgggcttcgatcttcagttaattagtgttgttaatcatgtttaattgtaattgggtatgttttagttacaagtaattaagttgattgggggttctagtggctactgcaatcaagtttttgggatatgcagagctacatttgaattagggttttagttggtccaattggggttttagtatgttaatatgatgtacaacatctccgccatggtgggctggtttttttc

SEQ ID NO: 16189 - DNA, 516 bp, Malus x domestica
  Predicted polypeptide sequence is orthologous to G5, G974
cccaagcccatcccgatgaagcaggtgggctcggctggttcgccgccgaaacccaccaagctttacaggggtgtaaggcaacgccactggggaaaatgggtcgctgagatcaggctccctaagaaccgaaccaggctctggctcggaactttcgacacggcggaggaagccgctttggcttacgacaaggcggcgtacaagctcagaggcgacttcgccaggctcaatttcccgcacctccgccacaacgggtccgtcgtcggaggcgagttcggcgagtacaagcctctgcattcctcagtcgacgccaagcttcaagccatctgcgaaggcttggccgaaactcacacacagggcaagtcggggaagccagccaagaggtcctccgccgccagccgacagccggagccggtgactttagcggtcaaggttgaaacctcgtcgccagtgacgactgataacgaaggatctgccgggtcttctccactatccggattaacttactgtaaacccaac

SEQ ID NO: 16190 - DNA, 607 bp, Malus x domestica
  Predicted polypeptide sequence is orthologous to G12, G24, G1277
atacaaccttggtggccaagtagcatgcaaaaaaccccctcccacctttctctctctgtctctctctctgtctctctctctctgtcttccaaaaagcagagcacccctttcgcactctcagaccgacatcaacaattgaaggagaacaattgaagatggagggcggcggcggagaggctgcgaataggaagagagctggggtggacaacgacaagccgtacaaggggatacggatgagaaagtggggcaagtgggtggccgagattcgtgaacccaacaagcgctctagaatctggcttggttcctactccactcctgtcgccgccgctcgggcgtacgacacggcggttttttacttgcggggtccctccgcgcggctcaattttccagaggctttgccggtcgaaggtggctgcgggtgcggtgacatgtcggcagctttgatacgcaagcgggccaccgaggtcggcgcccgggtagacgcggtcgaaacggctctgcgacaccaccgcggttcggcggcagggaacggagacggcgatgagattaaaccctgcttcgccggatgcgtggatcgggtcgacctgaacaagatgcccgaaccgga

SEQ ID NO: 16191 - DNA, 681 bp, Malus x domestica
  Predicted polypeptide sequence is orthologous to G12, G24, G1277
atttcaacttcttttctgattttttttttttttcatttgggttttcttgttttgtatttttaggatatatagcttctgaaaaaactacaacgacatcagaaaatctaagggtttggaatctttggatccatattagtcatattttagataggttaaattctttgccatggaaggagattactgctgctcttcgtcgtcttcttcctcaacgtccatgagcatggagaagcgcaagcatcccgatcaccaccaagaaaagcagtacagaggaataaggatgaggaagtgggggaagtgggtggcggagattcgagaacccaacaagcgctctcgaatttggctcggctcctacacgacccccgttgccgccgcccgagcgtacgacaccgccgttttctatctgcgaggcccttctgcccgcctcaacttcccggaacttgttttccaagacgacggccagcagccccacgacatgtcggcggcttcgataaggaagaaggcgacggaggttggggctaaggtcgacgctgcccaaaccgctctccactcatcgccgacgtctccatccaaaacggcgtcgagccggggtggctctcagaagcccgacttaaatgagtacccagacccaaaaaactccgatgaaagttaataaaaccgaacagagctttagggatgaggccg

SEQ ID NO: 16192 - DNA, 609 bp, Malus x domestica
  Predicted polypeptide sequence is orthologous to G12, G24, G1277
ttttttttttttttttttaaaattcaaagactataatttcaagaaaagaaacattactgatcgcccttcagttggtttgttgttacaatttagaaactacatcaaattaccaatcgaaacggaattcttgtgattccatttcctgatcggacccaataacaccttctctgtattttcactttattgcacacctaaatacctactcataacaataaacagctggtgatcggtcggccttctcaattaactttcatcggagttttctgggtcggggtactcatttaagtcgggcttcaaagagccaccccggctcaacgttgttttggactgcgacgtcggcgatgagcggagagcggtttgaacagcgtcaaccttagccccgacctccgtagccttcttccgtatcgaagccgccgacatgtcgtggagctgctggccgtcgtcttggaatacaagttccgggaagttgaggcgggcaaaaaggcctcgaaaaataaaaaaggcggtgtcgtaagctcgggcggcagccctgggggtcgtgttagaacccaacccaattccaaagcccttggtggggtctcaaatctcccccccccccttcccccactt

SEQ ID NO: 16193 - DNA, 547 bp, Malus x domestica
  Predicted polypeptide sequence is orthologous to G15
gttgacacatgtcgcgctatgattgacttgtgatgtcgacacgtgtcgcactgtgattggcttcctggttggagggaaactcttatgggttcttgacggtataacgttgaccggtgctcaatagtttcgggattagtcaagtatggtacaaacaaaactaattagggttcagtttggtgaagcttgaagagggagagagatgattatattctgaagaagatcgaagatgctgaaaagggattggaattagtttgtgcaaacgagattgttgtgctccctaaatacaagtaaattatgtatgtggcctgaatttgagttttacgatttcaattgacttatattatatgatcgaactatttactcagcttctgtattttcaacgtttgtaagtccattatgtttgatgatggtgatatatgcgctatcgtatgtcatttaactgataggccagagatacattgctcaaggtaatatgactacgactttgcaggttgtcattatttgtatgccttcatatgttgtgctgtaggtcatgtataagtttgag

SEQ ID NO: 16194 - DNA, 617 bp, Malus x domestica
  Predicted polypeptide sequence is orthologous to G15
gaaaaagcagtggattctcaagaggggcttcaatgtatagaggagttacaagacatcaccaacatggaagatggcaagctaggattggaagggttgctggaaataaggatctttatcttgggacattcagcactcaagaggaagctgctgaggcttatgacatagctgcaatcaaattccgaggactgaatgctgtgaccaactttgacataacacggtatgatgtggaccgaattatgtcaagcaataccctccttgccggtgaacttgctaagcgaaataaggaggttgtacccattaatgaggctactaatgaaaccaatgtttcgcaaatcggcaatggggaagccgttgtcccactgaagaatattagtgaaggggaagattggaaaatggcactctatcagtcctcccagcaacttgatcagaagcaaccaagcaccgaaactcagaatgtgattcaagcccaggcagaggactctaccaaaatggggaatgctcatttttccaatgcctcttcattggtgacaagcttaggcagctcaagagaagcaagccctgataagtcaagccagcctagtttcttcggaatgcctccatctgcttccaagtttttc

SEQ ID NO: 16195 - DNA, 741 bp, Malus x domestica
  Predicted polypeptide sequence is orthologous to G15
ccctcccaggaccatatcattaaccataattcactccactaagataaaaactacatgagctattgtttgcatgtaatttagtgaaaaaaactttccacggatgagcaaaaaacacatagcctatggctatggctatgcatctgtccaggctgtgaaaatccgcatgtgaggattggtgagtgctggcctggattggactgttgggatccaagaactcactgcatcacttgaacttgtgaaaaacttggaagcagatggaggcattccaaagaaactcggttggcttgacttatcagggctcccttctcttgagctacctaaacttgtcaccaatgaagatgcattggaaaaatgagcagcccccattttgccagagtcctctgcctcggcttgagtcacattgcgagtttcagcactcagttgcttctgatcaagttgctgggaggactggtagagtgccatttcccaatcttcaccttcactaatgttcttcagtgagacaacggcttccccattgccgatttgggcgacattgttttgattagtagcctcattaacgggcacaacctccttgtttcgcttagcaagttcactggcaagaagggtattgctagacataatctgatccacatcataccgtgttatgtcaaagttggtgacagcattcagtcctccaaatttgataccagctatgtcataaccctcaccagcttcctcctggggtgctgaatgtcccaaaaa

SEQ ID NO: 16196 - DNA, 583 bp, Malus x domestica
  Predicted polypeptide sequence is orthologous to G19
tgagagggctcttttttctctctaagtttctacaagtggcaatataaacatgtgtggtggtgctatcatttccgacttcatcgccgtcaagcgcgccctgaagctgacggcggaggacctctggtcagatcttgacaccatctctgacctccttggcatagactactccaacagcatcaacaaacagccggagaatcacaaggtggtccaaaagccgaaaccatctatcaccaaagtgacaagtgatgagaagcccaagcaggcaagcgggtctgctgctgccgcaaaaggcaagagagtgaggaaaaacgtgtacagaggaataaggcagaggccgtggggcaaatgggcggctgagattcgcgacccctacaaaggcgtccgggtctggctcggcacctatgacaccgctgaggaagccgcccgcgcttacgatgaagccgccgtgcgcatccgcggggacaaggccaagctcaactttgcccaaccaccatcctcttcaccgcttccatctctggcgccggatacgccgccgccgacaaagaggcggtgcattgttgctgagtcaactcgggtggagccg

SEQ ID NO: 16197 - DNA, 815 bp, Malus x domestica
  Predicted polypeptide sequence is orthologous to G19
atgagaaagctcttttttctctcaaagtttctacaagaggcaacataaacatgtgtggtggtgctatcatttccgacttcatcgccgccaagcgtggccggaagctgacggagaaggacctctggtcggagcttgacaccatctctgacctcctcggcatagaccactccaacagcatcaacaaacagcctgaggattacaaggtggtccagaagcccaaaccatcagtcaccaaagcgacaagtgatgcgaagcccaagaaggccaccggggcagctgccgctgctgctgcagaaggcaagagagtgaggaaaaatgtgtacagaggaataaggcagaggccgtggggcaaatgggcggctgagattcgcgacccccgcaaaggcgtccgagtctggctcggcacctacaacaccgccgaggaagccgcccgcgcctacgacgaagctgccgtgcgcatccgcggcgacaaggccaagctcaacttttcacaaccaccaccctcttcactgcttccacctctggctccggctacgccgccgccgacaaagaagcggtgcattgttgctgaatcaactcgggtggagtcgactcaaccgagtttccacaccggttcttactattatgatacattttatcagggtgacggtgaatatgtatgctaaaaaatgagggggccgaaggtgacggaaggggtatgtaccataaggaccaaataatcgaagcttggaagtattttattttgaggtctgggaaaaaaggtggtggacaaggaatcacaacccaaccccaagcccggcttattacttcaaata

SEQ ID NO: 16198 - DNA, 495 bp, Malus x domestica
  Predicted polypeptide sequence is orthologous to G21
ggttttgcttatctcaatttccctgaattggctcaagcacttccccagccagactccaagtctccaaaggacatccaagctgctgctgccaaggcagctgctgcttctgcttctgaggataagcagcttatatgtgaagcagaaactaaagaagcggagcccaagatccctatatcaacaaattcaaccttgtccaatgctcaagaatcaagtagcacttgtgcttctggttcaacagattacgatgatgagaaattgtttgacctaccagatcttttcatggatgggaaagatggaagtgatattttttgcaattattcttcttcaacttggcatttgtgtgcagctgacactggattcaggctaggggacccattcttatgggagtattagttagccagtacagattaaggactgtatttttctcttttttatttaatttatttttatcaaacataaataattaagtttcaaaaaaaaaaaaaaaaaatcggt

SEQ ID NO: 16199 - DNA, 617 bp, Malus x domestica
  Predicted polypeptide sequence is orthologous to G25
taattaacaatctaatcaaagattaaacgcctccaatacagattaatcaggaagaaactaatgatcaaaatcatcaattttgcccgactgactcaatttacgatcgcttaaattaaaacaaactaataaaagcagacaacattaatcacacggaagcaggaacgctctcgtcgtcaacgaagctccaaaggtcatcactgacggtgctttcttgaggcggaggattctggggagtcgccgtgaactgcccgtccagataaggaatctgatagaatttcatcatgttctcgtacgccattagctcctcagaaagcttctgcacttcgtcatcttccattcttgcaatcgcctccaagctcaattccccttcttgtgtttcctccacttctgtcagctcagatccgccttgacaaccgcccatcccgttctgattgcaacccagcaaccccttcgaggagaaagcgccatctgaaccagaccaagagttttcttccccggaaataacaattgggtcggtgttcgcaatggccatggagttaaacccatctgaattggaattggagggaaatgccgcaaactggttcagatcatacccaaatcccaattcaaagcttttg

SEQ ID NO: 16200 - DNA, 701 bp, Malus x domestica
  Predicted polypeptide sequence is orthologous to G43, G46, G1419
agctgatgcaaggcactaccggggtgtgaggagaaggccgtggggaaagtacgcagcggagattcgtgacccaaacagaaggggatcccgggtttggctcggaaccttcgacaccgccattgaagccgccaaagcttacgacgttgctgctttcaagctgcgtggaagcaaagcaattctcaactttccacttgaagctggaagatcagcagaactctcagccgatcatcctctgctggtcagcagaaaaaggaggagagaacggatcaccgaaagtcatgagagttccggtgagatgatcagaaacaaagagataaagaaggaggaggatgttcaggatgtaaaaatccccgcccaagagagagtttcgaccgccgtttgcccattaacaccgtcaagttggacggcggtttgggatctgagcaaagaaaacgaactggggattttcagtgtgcctcctctgtctccgttatctcctcaccccaatttcatgggatattctcagctcatggttacttgaacttttaatttatggttatcattccttcattgccagagtttaatttgtatcatccatctgcaaaaaagcagcataaacagagtactgtaaatagtccagagcaatatggattgaagaactcatattgttttttaagtttgatttgtttatatattcctttaatctttgtataatgaaatac

SEQ ID NO: 16201 - DNA, 618 bp, Malus x domestica
  Predicted polypeptide sequence is orthologous to G43, G46, G1419
cacgaggttaataaatttgtacatacaaatttgatacggtagaatattacagaccatgcatatagtaaatcagtaaatccgtcctccaatcatattctaacatatcggcagaggaggatcctgagattaacacagctccttcaagtgccttctccttcccaaagcacccaactttgaagctccagttcttcagtctcagctacctcctcctgctttaccgatctcctcctcttccgcgccgtgttcaccggcggttccgacactccggcctccaacggaaaattcagtattgctttcctacccctcagcttaaatgcagcacaatcataggccttggcagcatcaacatcagtgtcaaatgtccctagccaaacccgagtacctttccgggccggatcacgtatctccgccgcgtattttccccacggcctccgccggactcccctgtaatgccttaacgcatcaccagggcctgaaacctgttgtaattcatcttttggaccgggattttgagaagtactattttttctctttggtgagctcaaattcaggggctctacttccatggatggtaagttaacgaatttttgggtttcgtttcggaatttgagaattggg

SEQ ID NO: 16202 - DNA, 413 bp, Malus x domestica
  Predicted polypeptide sequence is orthologous to G44
gaaggcggtggtggctgtaaagaaggagaagttgacggaaactccattgacgccgtcatgttggatggcgttctgggactcagagaaggaggacgtgaaaggagtttttaacgtgcctccattgtcgccgttatctcctcatccagccgtgggttgtccacagcttatggtcgtatgagggattgaacgttggtgtgtgattagaaattagaagctggttttttatttttattgttttgaattatttagaaagaataaaaaaaaagctatataaattgtcccgtacatgatatatgtgcgtgagattttccgacaactaagggttcaattggactaaaaattataccttatttaaaaaattaaaattattaaaaattagatttaaaaaaaaaaaaaaaaaaaaaaaaaaaaaa

SEQ ID NO: 16203 - DNA, 610 bp, Malus x domestica
  Predicted polypeptide sequence is orthologous to G44
acacttctagtcttcacttctttcttagtttttgaagtttctaagaactcgtttgaaagtgtttctatttagggtttttgaaatggcatcagaagactcttcagctttagagcagattaggcaacaccttttgaatgaatttacaacagtggatagcttcatcaccagtctcaacctttgcacctcccatatcccccaaaaacatgaaatcacccaatcacccttcaacacagcttcctcctcctcctccaccacctcctccgcaatcaccaccagcaccaccaacattggtagtgaatctactgaccaatatttcaaaatctccgattacttagtccctgaaattgatcaagacacccaattcgaaaccaaaccccaaatctcccacccaaaacctccaaaacactcaactctcagccaccgcaagcccgccataaacgtggccattccatccccaccaactctgtcgtcttcttctggtgatgaaaatcaaaacacatcaaacacttccaccgtggttgaagctgaagcaaggcactaccggggtgtgaggaaaaagccgtggggaaagtaccccgcggaaaatcctgacccagaactaagggggacc

SEQ ID NO: 16204 - DNA, 616 bp, Malus x domestica
  misc_feature (449)..(449): n is a, c, g, or t
  Predicted polypeptide sequence is orthologous to G129, G136, G140, G146
cgcattttttttttttttttttatttatatatcagacatatataataaatgttcaaaccaacattatgaaagattcgatcacatgtaagttggaggaacttgttagggtaatttctcacagaaatcttagtagtacacattgctgcaggcataaatataaaaatacagatgagaaatccgctttcatatactaaaatacgtacgtatgcctacgtacttggtaccaacggtcttcattcccaaagcaatcttgatcattcatctggtgttattatacacgcccaccacagtaaactaaatcagcagaagcaatacagaccaagcatatatattaaactaattgaagggaaatctgatcgcggcggggattgtagtgatgattgggttgtaacacgttcacttggaaatagtcccgagagtcgtatggctgaaactgcaagatctcatancttcctcctccagccatcacatttatgttctgctggcccctctcattctcaactatctttgctcgtaggagctggtaattgttgtgcaagtccagttcccttttccgcttgtactcaatttcggcaaaaaagaactcaatctttttggatcggattctactaatgga

SEQ ID NO: 16205 - DNA, 876 bp, Malus x domestica
  Predicted polypeptide sequence is orthologous to G129, G136, G140, G146
gcaattcttccttcccgttgccaagtgcaaccccaatagaaaaactcaaagtcaagaactagctaacagagaaaaccacaattcatcaatttggaggggtttttgccatttttcatccttgcaacaatggagttcccaaatcaagcacccgagagctcctcccagaaaaaattgggaaggggcaaaattgagattaagcggatcgaaaacactacaaatcgacaagttaccttctgcaaacgccgcaacggattgcttaagaaagcctatgaattgtctgttctttgtgatgctgaagttgctcttatcgtgttctccaaccgtggccgcctctatgagtatgctaacaacagtgttagagcaacaatcgacaggtacaaaaaagcatacgctgatcctacgaacagtggatctgtttcagaagccaacactcagttttatcagcaggaagcatccaaactgcgaagacagatccgagaaattcagaattcaaacaggcatatactgggtgaagctcttagctccttgaacgccaaggaactgaagaacctagaaggaagattggagaaaggaatcagcagaataagatccaaaaagaatgaaatgctgttttctgaaatcgaattcatgcaaaaaagggagaccgagctgcaacaccacaacaattttctgagagcaaagatagctgaaaacgagagggaagagcagcagcatacacacatgatgccgggaacttcctacgatcagtcaatgccttcgcattcttatgacaggaacttcctcccagcggtgatcttggagtccaacaataaccattaccctcaccaagtccagacagctctccaacttgtttgaaatgctggactgccgtctgat

SEQ ID NO: 16206 - DNA, 1037 bp, Malus x domestica
  Predicted polypeptide sequence is orthologous to G129, G136, G140, G146
ttctttattttctgcatatctccttgtttagatttgtggagctgtgaaaaaatcccaaaagcttccaactatggcctatgaaagcaaatccttgtccttggactctccccagagaaaattgggtaggggaaagatcgagattaagcggatcgaaaacacaacgaatcgtcaagtgaccttctgcaagaggcgcaatgggttgctcaagaaggcctatgaactctctgtgctctgtgatgcagaggttgctctcatagtcttctctaaccgtggccgcctctatgagtatgccaacaatagtgttaaaggaacaattgagaggtacaagaaggcaagtgcagattcttcaaatactggatcagtttctgaagctagtactcagtactaccagcaagaagctgcgaaattgcgtgcgcggatagtgaaattgcagaatgacaaccggaatatgatgggtgatgcattgaatagtatgtctgtcaaggacctgaagagcctggagaataaactggagaaagcaattagcagaatccgatccaaaaagaatgagctcttgtttgccgaaattgagtacatgcagaaaagggaactggacttgcacaacaataaccagctcctacgagcaaagatagctgagaatgagagggccagcagaacattaaatgtgatggccggaggaggaacttcaagctatgacatcctgcagtctcagccatacgactctcggaactatttccaagtgaacgcgttacaacccaatcatcagtacaatccccgccacgatcagatttctcttcaattagtatgaatgatccagattgcttggggaatgaagaccgttaccaagtacgtaggtatacgtacgtatattagttgatggaaggggatttcttgtctgtatttttatatttatgcctcctgcaacgtgtactactaagacttctgtgagacattaccctaacaagttcttccaactttgatgtgattgaatcttcataatgttggtttgaatatctattatatatgtgtctgataaa

SEQ ID NO: 16207 - DNA, 1065 bp, Malus x domestica
  Predicted polypeptide sequence is orthologous to G129, G136, G140, G146
acccacttcccacttctgcaattcttccttccggttgccaagtgcaaccccaaaagaaaaactcaaagtcaagaactaacagaaagagccacaattcatctattttgaggggtttttgccatttttcatccttgtaacaatggagttcgcaaatcaagcacctgagagctctacccaaaaaaaattgggaagaggcaaaattgagattaagcggatcgaaaacactaccaatcgacaagtcaccttctgcaaacgccgcaacggattgcttaagaaagcctatgaattgtctgttctttgtgatgctgaagttgctcttatcgtcttctccacccgtggccgcctctatgagtatgctaacaacagcgttagagcaacaatcgacaggtacaaaaaagcatgcgctgattctacggacggtggatctgtatcagaagctaacactcagttttatcagcaggaagcatcaaaactgcgaagacagatccgagaaattcagaattcaaacaggcatatactgggggaatcccttagcaccttgaaagtcaaggaactgaaaaacctagaaggaagattggagaaaggaatcagcagaataagatccaaaaagaatgaaatcctgttttctgaaatcgaattcatgcaaaagagggagactgagctgcaacaccacaacaattttctgagagcaaagatagctgaaagcgagagggaacagcagcagcagcaaacacatatgattccgggaacttcctacgatccgtcgatgccttcgaattcgtatgacaggaacttcttccctgtgatcttggagtccaataataaccattaccctcgccaaggccagacagctctccaacttgtttgaaatgctggactgccgtctgatgttcttctatccatatcctctgatctgtcttcataaatctatgagataattgacgttgtagtttttatgtatatgggagaaccagtttgctcatgttctccataatatatatatgtgtgatgatggaccccaattctgtgataacatatatagtaaattttattttctcaccccga

SEQ ID NO: 16208 - DNA, 877 bp, Malus x domestica
  Predicted polypeptide sequence is orthologous to G129, G136, G140, G146
cagatattaagatggggaggggaaagattgaaatcaagaggatcgagaacacgacgaatcggcaagtgaccttctgcaaacgaagaaatgggctgctgaagaaagcatatgaactatccattctctgtgatgctgaagttgccctcattgtcttctctactcgtggccgtctctacgagtactctaacaacaacagcataagaaacaccatagagaggtacaagaaggcatgttcagatagcacaggatcatcctctgttactgaaattaacgctcagaactctaacaggcacttaatgggagatgccttgagcactctgactgtgaaagaactaaagcaggtggagaataggcttgaacgaggcattactagaatcaggtccaagaagcatgaactgctgcttgcagagattgagtacttccagaaaaaggagattgagctggaaaacgaaaatgtttattttcgaactaaggtatcagaagtcgagaggcttcaacaagcaaacatggtttctgggtcagagatgaatgcaatccaggcattagcttctcgccatttctttagccagaatatgatcgagggtggagaagctaccttcccacagcaagacaagaagaacctccatcttgggtaactaattagctttttgaaggcagaatcttcaaatgcaggaaatgctacctcaatcatcttaattatatccagataataatgatgatatatcttctcttatgctgaacaacttttctaattactagctttattatgtatttgtaaggattgtaatatgactttggggtttagtacccagtactacccagaataattactactacactatgatctggtattcaataagtttaaattaattagctt

SEQ ID NO: 16209 - DNA, 642 bp, Malus x domestica
  Predicted polypeptide sequence is orthologous to G129
atctccatgattggtgccgttgaagcttagaggagggttgtacaagtgagagacggtagatcacagaatgtgtgtaggattacccttacagattacaaagctgtcctgttgtaaactgaagtgagttttgtggtctttgtcaatttagttttgttaataaaatcttcctgtgatcttgttcaaattattttgtcaaataatttctccaaaatgtgggatttccctttggaagaaatctgaaaacgagagggaagagcagcagcatacacacatgatgccgggaacttcctacgatcagtcaatgccttcgcattcttatgacaggaacttcctcccagcggtgatcttggagtccaacaataaccattaccctcaccaagtccagacagctctccaacttgtttgaaatgctggactgccgtctgatgttcttctatccatatcatctgatctgttttcttaaatctatgagataattggttgtagtttttatgtatatgggagaaccagtttgttgttcatgttctctataatatcagaattttctgtattaactagctactctttcaactatgatgacaagtaaatttgatttctcaacctaattaaagtttccatctcaaaaaaaaaaaaaaaaaatgc

SEQ ID NO: 16210 - DNA, 605 bp, Malus x domestica
  Predicted polypeptide sequence is orthologous to G131, G135, G155
cgcattttttttttttttttttggcaaagaaatattcctttttatcatcgtttatatggatagaaacttatgcataacgtcgatccacaacatcatacaatgtacattaatttccacgaacttcatatagttcgtacacaagaaattagaaacacacaacagcaaaagctatgatcgcagtccctcacaacagcaaaagctggagccactaattatatgtaagcagctttttcaaattaattgggcagcagctggtgttgctgcgagaacataacccttggaaatgcactcatgcatgcatttgctcccaaagtagttgtcgaggtcgacgaagtgacatcagcaaaatgaaactcctgcaacttaactcttttttgcagacgcttgttttcttctcgcaattctttatgctttcttttcagcaagttgacgttctccgaaatgatctgtctcgatttagagcggatgcgttcaaccccagtttttaactggctttccaattgctttaattcttgcataccaagcgttgatagctcctctccagccaagtgcttcagccgcatttcgagggtttggattgatcttcttaactcttcgggttcaat

SEQ ID NO: 16211 - DNA, 831 bp, Malus x domestica
  Predicted polypeptide sequence is orthologous to G131, G135, G155
tctgggggtttcggttgtttggtttttttgagaaagaaaatcaaagaacaagcagttgaaagagtgagtggtaactcagagtccataaatatttaatcatggggagaggtagagttcagctgaagcgcatagagaacaagatcaacaggcaggtgactttttccaaaagaagcactgggctgctgaagaaggctcatgagatctctgtcttgtgtgatgctcaggttgctttgattgtcttctccaacaaggggaagctccttgagtacgccacagattcatgtatggagcaaatccttgaacgctatgaaagatactcttacgcagaaagacagctagttgaaccagattttgagtcacagggtaactggacctttgaatattccagactaaaggctaaagttgaggttttgcaaagaaaccataggcactatttgggagaagacctggattccttgactctcaaggaaatccaaagtttggagcaacagcttgacaccgctcataaacaaattcgattaagaaaaaatcaactcatgcatgaatccatcactgagcttcagagaaaggaaaaggcgatacaggagcaaaataacttgctagcaaagaagataaaggagaaggagaaggctgcagctcagccccaggttcaaaactgggagcagcagaaccatgaccttgacctgcttccacagccccttccatgtcttaacattggggggacgcagcaagatgaattccttcaagtgaggaggaaccagctggaccttacactggaaccattttattcatgccatctcggatgctttgctgcttgatcatcaatgggta

SEQ ID NO: 16212 - DNA, 1096 bp, Malus x domestica
  Predicted polypeptide sequence is orthologous to G131, G135, G155
cttcctcatcctgcttttgcttttcatcatcattcagctccctttcctttcttgtatgaaccaaattagggttttctctcaaatttggtatattttccatctcttgggtttctaagcattaaaaaagaaagtgctatttcttccgcttctcccctttctagttttagcaatatataagaaaaaacaagagagggaaaagaagaagaaatgggaagaggtaaggtgcagatgaagcggatcgagaacaagataagcaggcaagtaacgttttcaaagaggaggagtggattgctcaaaaaagctcatgagatctctgttctgtgtgatgctgaggtggcagttattgtcttctccaccgtagggaagctctttgagtattctactgatttcagcatggtgaggattctggatcgatacgaccaatattcctatgcagaacggcaacgcaccggagctgattctgaatcacaggaaaactggccggtggaataccccaagcttgcggcaaggattgaagtcttacaaaggaaactaaggaatttggtgggagaagatttagaccccttaagcttgagagagcttcaagatttggagcaacagcttgatacagctcttaagcgcatacgaacaagaaagaaccaactcgtgcatgaatccatttcagagatggacaagaagcgaaaggctctacgggaactaaacaagtcgctagcaaagaaggtgaaggagaataaaacgatgcttgaggaagaacatgaccaggtgcaggtagtagggcagcagcaaactaaccaaggccgccacaactcatccaccctcatgctcatgccgccgccgccccaacccccatcaacaccaacactacctacttttcgaaccaccaggtacgatctctctctctctctctctctcagcgatgtttctgttaagcaatatgcagaaggagaatagagaagttgcagaggaagaagaataagaaaacagagaaggttgagagagagagagagagagagaaagtgtgtgaattgcatttgtattttcttctttccttcaatgattacaatgatacagctatatagaagattacttgaatcta

SEQ ID NO: 16213 - DNA, 1176 bp, Malus x domestica
  Predicted polypeptide sequence is orthologous to G131, G135, G155
cttcctcatcctgcttttgcttttcatcatcattcagctccctttcctttcttgtatgaaccaaattagggttttctctcaaatttggtatattttccatctcttgggtttctaagcattaaaaaagaaagtgctatttcttccgcttctcccctttctagttttagcaatatataagaaaaaacaagagagggaaaagaagaagaaatgggaagaggtaaggtgcagatgaagcggatcgagaacaagataagcaggcaagtaacgttttcaaagaggaggagtggattgctcaaaaaagctcatgagatctctgttctgtgtgatgctgaggtggcagttattgtcttctccaccgtagggaagctctttgagtattctactgatttcagcatggtgaggattctggatcgatacgaccaatattcctatgcagaacggcaacgcaccggagctgattctgaatcacaggaaaactggccggtggaataccccaagcttgcggcaaggattgaagtcttacaaaggaaactaaggaatttggtgggagaagatttagaccccttaagcttgagagagcttcaagatttggagcaacagcttgatacagctcttaagcgcatacgagcaagaaagaaccaactcgtgcatgaatccatttcagagatggacaagaagcgaaaggctctacgggaactaaacaagtcgctagcaaagaaggtgaaggagaataaaacgatgcttgaggaagaacatgaccaggtgcaggtagtagggcagcagcaaactaaccaaggccgccacaactcatccaccctcatgctcatgccgccgccgccccaacccccatcaacaccaacactacctacttttcgaaccaccagaaaatcatgcagtgggggagtccaggcaagaggagcagtggatgacaatgattctgataaaggcggaagacctccacctcgaccggctgctgctacaaacacacgcatgccactgtggatgctttcgccatttgaatgaaatataagcttcgccggaagacgaccacctcgaccggcggaataccttctaatgctttcgccatttgaatgaaatataagctttcgccatttgaataaaatataagctttgctattgtaattaaagaataatattaaaaacaatgtttctgca

SEQ ID NO: 16214 - DNA, 1055 bp, Malus x domestica
  Predicted polypeptide sequence is orthologous to G131, G135, G155
cagtttctgggttgtctttcttttttggttgtttgggttttttgagaaagaaaaacagagaacaagcagttgaaagagttgagtggcaactgagagtccataagtatttaatcatggggagaggtagagttcagcttaagcgcatagagaacaagatcaacaggcaggtgactttttccaaaagaagaactgggctgctgaagaaggctcatgagatctctgtcttgtgtgatgctcaggttgctttgattgtcttctccaacaagggcaagctctttgagtacgccacagattcatgcatggagcaaatcctcgaacgctatgaaagatactcttacgccgaaagacagctagtcgaaccagattttgagtcacagggtaactggacctttgaatattccagactaaaggctaaggctgaggttttgcaaagaaaccataggcactatttgggagaagacctggattccttgactctcaaggaaatccaaaatttggagcaacagcttgacaccgctcttaaacaaattcgattaagaaaaaaccaactcatgaatgaatccatctctgagcttcagagaaagagaaaggcgatacaggaggaaaataacttgctagcaaagaagataaaggagaaggagaaggctgcagctcagccccaggttcaaaactgggagcagcagaaccatggccttgacctgcttccacagccacttccatgtctaaacaatggggggacgcagcaagatgaattccttcaagtgaggaggaaccagctggacctgactctggaaccattatatgaatgccatctcggatgctttgctgcttgatcatcaatcgttagaaaaaggtggaagaattaaatggaaagaaaacaaaactacatatgtgtgctatttctgtattaaatttctggtttcttggtaaatttggaccaaccctgaacgtagtagcaatccatatatgaggaattgaactttgaaagtggtctgtaaatctatttatattcatgccaaaaacctgagaaatattgagtataaaaaaaaaaaaaa

SEQ ID NO: 16215 - DNA, 1230 bp, Malus x domestica
  Predicted polypeptide sequence is orthologous to G131, G135, G155
gtcactcatatatagacagagaaggagagagaccagacccctaccttagagagagagagagagcagaagccatctgtgtgtcaactggttctttctctcccatttttcttggtttcttggtgggatttctggtttctctaaactaagagatcagttcagcaggaacaaccgtatatatattactaggattattaattatttatttataataataaataattgttagagagattatggggaggggaagggtgcagctgaagagaattgagaacaagatcaacaggcaggtgaccttctcaaagagaaggtcggggctgatgaagaaagctcatgagatttctgtgctttgtgatgctgaggttgctttgattatcttctccaccaagggcaagctctttgagtactccaatgattcctgcatggaaaggatcctggaaaggtacgaaagatactcatatacagagaggcagcttcttgcaaatgataatgaatccactggaagctggactctggaacatgcaaagctcaaggctagggtggaggttttacaaagaaatcaaagacactatatgggagaagatctccaatccttaagtctcaaagagcttcaaaatttagagcaacagcttgattctgcactgaagcacataaggtcaagaaagaaccaagttatgtacgaatcgatttctgagctccagaagaaggataaggcattgcaggagcaaaacaacttgctggcaaagaaggtgaaggagaaggagaacgcagtagctcaacaggcccaattggagcatgtgcaggagcagaggttgaactcctcttcctcccttcttccacgggcattgcagtccttgaatttcggcagcgggtccaattaccaggccattagatcaagtgaaggaataccaggagataatcagcagtatggagatgaaaccccaactccacatagacctaacatgctgctgcccgcttggatcgtccgccaccttaatgaatagaagaattcatcaccatgaaataatattatctccaaagggaataatattatgtgacatcaattaatcaagtaaacatattatacttatatatatatatatatatatatctatatatctataccaagaaattaattggtaatgtgcatgatgaaaaccctagactcgatctatctctaaatgtgtatcgtatgttggaattcattaatatatcttaagggcttgtttggta

SEQ ID NO: 16216 - DNA, 665 bp, Malus x domestica
  Predicted polypeptide sequence is orthologous to G131, G135, G155
caacagcttgattctgcactaaggcgcataaggtcaagaaagaaccaagtcatgtacgaatcgatttctgagctccagaagaaggataaggcattgcaggagcaaaacaacttgctggcaaagaatgtaaaggagaaggagaaagcagtaacttcacaggcacaattggagcatgcgcagaagcagagcttggactcctcctccacccttctaccacaggaattgcagtacttgaatttcagcaggtccaattaccaccaggctattagatcaagtaatggaatatcaggagataatcagcaggatggagatgaaaccgcgactccacatagacctaacacgctgctgcctccttggatgctccgccaccttaatgaatagaagcatttcatcaccatgaaataatatatccaaataatattaaaacaccaattaatcaagcaaacatactacacttatatatgtatacctagaaattaattggtatgtgcctgatcaaaaccctagcctcgatctagctccagatgtgtatcgtatattggaattcaattactagaattaatagcccaaaaactgtgttaggggttgtctacctcttgtaattaatgtactattttcaaattaacttaggaaacgtgcatgtgcgcactttgtccaaaaaaaaa

SEQ ID NO: 16217 - DNA, 1043 bp, Malus x domestica
  Predicted polypeptide sequence is orthologous to G133
atatcaactaaaacaagatctgaaaattactagaaaaaagtaagaaaattgagagagagattatgggtcgtggaaagattgagatcaagctgatcgaaaaccagaccaacaggcaggtgacctactccaagagaagaaatgggatcttcaagaaggctcaggagctcaccgttctctgtgatgccaaggtctccctcatcatgctctccaacactagtaaaatgcacgagtatatcagccctaccactacgaccaagagtatgtatgatgactatcagaaaactatggggatcgatctatggaggacacactacgagtctatgaaagacaccttgtggaagttgaaagagatcaacaataagctgaggagagagatcaggcagaggttgggccatgatctaaatggtctgagctatgacgatctccgttctcttgaggataagatgcaatcttccttagatgccatacgtgaaagaaagtaccatgtgatcaaaactcaaacggagaccaccaagaagaaggttaagaacttggaggaaagaagaggaaacatgctgcatggctatgaagctgccagtgagaatccacaatattgttatgtggacaatgagggagactatgaatctgcacttgtgttggcaaatggggcaaataacttgtacactttccagctccaccgcaactccgaccagctccaccaccctaacctccaccaccacagaggaagttcgctcggctcctccatcactcatctacatgatctccgccttgcttgatcgtgatccgagagatgattaatcgccactaagttttatattaaggtcacttataattttatatatattcctcagagacttaactgcttatgttctaaagtgtttttttagtgatgatctttaggcacttggattacctctaaaaacatatgcataaatatatctgggatgttttatttaatgataacactaacacaagaatctatggcctgaaagtaataatattatgaacacttccgtgcccaaaaaaaaaaaaaaaaaaaaaaa

SEQ ID NO: 16218 - DNA, 1102 bp, Malus x domestica
  Predicted polypeptide sequence is orthologous to G133
atatatcaagtaaaacaagatcagaaaattgctaggaaaaggtaagaaatttgagagagagagagaaattatgggtcgtgggaagattgaaatcaagctgatcgaaaaccagaccaacaggcaggtgacctactccaagagaagaaatgggatcttcaagaaggctcaggagctcaccgttctctgtgatgccaaggtctccctcattatgctctccaacactaataaaatgcacgagtatatcagccctaccactacgaccaagagtatgtatgatgactatcagaaaactatggggatcgatctgtggaggacacacgaggagtcgatgaaagacaccttgtggaagttgaaagagatcaacaataagctgaggagagagatcaggcagaggttgggccatgatctaaatggcctgagctttgacgagctggcttctcttgacgatgagatgcagtcttccttggatgccatacgtcaaaggaagtaccatgtgatcaaaactcagacggagaccaccaagaagaaggttaagaacttggagcaaagaagaggaaacatgctgcatggctattttgaccaggaagcagccggcgaggatccacagtatggttatgaggacaatgagggagactacgaatctgcacttgcattgtcaaatggggcgaataacttgtacactttccacctccaccaccgtaacctccaccacggaggaagttcgctcggctcctccattactcatctgcacgatctccgccttgcttgatcgtgatctgagatatgattaatcatcactaagttatatattaaggtcacttataactgcttttgttctaaagtgtttgcttggtgactatctttaggcaaggagttagacttggactacctctgaaaacagatgcataaatatgtgtgtggtgttttaatcaatgatagcactaaaaaaatccgcgcccttgttgcttgtgggtttgtttgtataattaatacttctattctatatatatcatggcagacattgcttttgatattttggtttgtttgtcttggatgtcttgtattggctttagggacttgtttggaaaagacaataactgcc

SEQ ID NO: 16219 - DNA, 890 bp, Malus x domestica
  Predicted polypeptide sequence is orthologous to G134
gaatgggattatcaagaaagcaaaggagatcactgttctatgtgatgctaaagtatctcttatcatttattctagctctgggaagatggttgaatactgcagcccttcaactacgctgacagaaatcttggacaaataccatggacaatctgggaagaagttgtgggatgctaagcatgagaacctcagcaatgaagtggatagagtcaagaaagacaatgacagcatgcaagtagagctcaggcatctgaagggagaggatatcacatcattgaaccatgtagagctgatggccttagaggaagcacttgaaaatggccttacaagtatccgggacaagcagtccaagttcgtcgacatgatgagagacaatggaaaggcactggaagatgagaataagcgcctcacttatgagctgcaaaaacaacaggagatgaaaatagaagagaatgtgagaaacatggaaaatgggtatcatcagaggcagctggggaactacaacaacaaccagcagcagataccttttgccttccgcgtgcagcctattcagccaaatctccaggagagaatctaattagatatatcttgcatttgcatgctctttctaactagttatattatctctccacctctctctctcttttcatctgtcaaggagttcttaagtttatgtcagatttccaatggtttgtaatggaattagcttcgttatgaggctttgttgtgaaccttgtaataattaaggcgtgcatgaactcggtatgtgggaaaatcactataatgtatgccccagtgcaacatgtacttgtgtgtgtatacctaactttatgtgcttagctatacatatctatctcttccaaaccggtaaaaaaaagaaaaaaaaaaaaaaa

SEQ ID NO: 16220 - DNA, 1055 bp, Malus x domestica
  Predicted polypeptide sequence is orthologous to G137, G145
taacttagcataccctagagaacacgaatatcaaaaagggaaaacaaaacctagtaacataatataataatttgatatgtatgcaatcactgaaatatatttttataatataataagttaaaaagaggaatgggaagagggaaggtggagttgaagaggatcgagaataagataaatcgacaggtaacatttgcaaaaagaaggaatgggctgctaaagaaggcgtacgaactctcagttctctgtgatgctgaggttgctctcatcgtcttctccaccagcggaaagctctatgagttctgcagcggccctagcatagcgaagacgcttgagaggcatcaaagatgcacttatggagaactgggagcaagtcaatctgctgaggacgaacagagcagataccaagaatacttgaagctaaaaacgaaagtagaggccctacaacgcacgcagagacatcttcttggggaagatttggttcatttaggcacgaaggagcttcagcagcttgagaatcaactagatgtgtcgatgaagaaaatcaggtcaacgaagacccaatttatgcatgttcagatttctgagcttcaaaggaaagaagaaatgctactggaagcaaacactggactgagaaggaagttggaagaaattactgctggccatcaacgatcatggaatggcaatcaccaggctgctcaattagaaggattccctgagcatttgcaatacaacaatgcattgcagatcggtactccagtagtaacaaatgatgaggcgaatgtagcaacgtcctcagcacaaaatggtacgggattcttccccggttggatgctctgaatttcgaatcatgcatggtaaccaatcaaagagtagtggtgaccacatgtgttgtttcactgtccaaaagaataagaacgttaataatttgctgcctagtatcttttaatgttatagaagggttcattcattcatgagactaatgcccaagaattcatcacgattgttgtgccctaaaatatttcatttggattttaactttaccagtgagtagtata

SEQ ID NO: 16221 - DNA, 964 bp, Malus x domestica
  Predicted polypeptide sequence is orthologous to G137, G145
gaagagtggagctgaagaggatagagaacaagataaacaggcaagtcacatttgcaaagagaagaaatgggcttctgaagaaagcttatgagctctccgttctctgtgatgctgaggttgctctcatcgtcttttccaaccgtggcaagctctatgagttttgtagcagccctagcattctccaaaccgtagacaggtaccaaaagtgcagttatggtgcggtggatcaagtcaacatacctgcaaaggaacttgagagcagctatcgtgagtacatgaaactcaaaggtagatgtgagtccctacaacgaactcagagaaatcttcttggtgaggaattgggtccattaaacacaaaggagcttgagcagcttgagcgccaacttgaggcctccttgaagcaagttaggtccactaagacccagtatatgctggaccaactttctgcccttcagaacaaggaacaactgttaatcgaagccaacagggatttgacaatgaagttggatgaaattggttcaagaaatcaacttagacagtcatgggaaggaggtgaccagggcatggcatatggaacccagcatcaccatgctcaatcccaagggttcttccagcctttagattgcaatcccactttgcaaatagggtaccctgcagaggggtcagagcagatgggtgccacaactcatgcccaacaagtgaactgtttcatccccggatggatgctttgagtttgtgctgctgatgaatctgatcagtgcctctaatcagccataaaaaaacatatacccaagtttatgcttttttttttctttttttctggcaatatataaactgcatgtaaccttaatttcacataaaatcagcagtgactgcatttcaaggggacctttcaaaggcctaaagtccttttaacttttgttagagggcttaagtttacaatattgcgaacttatttcttgct

SEQ ID NO: 16222 - DNA, 1291 bp, Malus x domestica
  Predicted polypeptide sequence is orthologous to G137, G145
ttggaacctgaggttattgacccaaaagaaaaatcaggattggaacctgaggttaagaagataagccatcactcaagagacagaactacaagacaatcagctctaatctttctctctcttccactctctctctctctctctctctctctctctctctctctctctctctctctgtgtagggttttccaactgagtgagtatctaactttctcttgtgtttcacaaatttggttacagtttggtactgacctagaaaaggaggatcagtttgtaccaaagagagagagaagaacaagaaagggaaagaaaatattgtcaagatcaaaacttttggagattagatacacaaaataatatttttagtaactaaggacatggggagaggaagagtggagctgaagaggatagagaacaagataaacaggcaagtcacatttgcaaagagaagaaatgggcttctgaagaaagcttatgagctctccgttctctgtgatgctgaggttgctctcatcatcttctccaaccgtggcaagctctatgagttttgcagcagctctagcattctcaaaacactagacaggtaccaaaaatgcagttatggtgcagtggatcaagttaatagacctgcaaaggaacttgagagcagctatcgtgagtacatgaaactcaaaggtagatatgagtccctacaacgaactcagagaaaccttcttggtgaggacttgggtccattaaacacaaaggaacttgagcagcttgagcgtcaacttgagggctccttgaagcaagttaggtccactaagacccagtatatgctggaccaactttctgaccttcagaacaaggaacaactgttaatagaagccaacagggatttgacaatgaagttggatgaaattagttcaagaaatcaacttagacaatcatgggaaggtggtgaccagggtatggcatatgcaacccagcatcaccatgctcaatcccaaggattcttccagcctttagattgcaatcccactttgcaaatggggtactctgcagtggggtcagagcagatgagtgctacaactaatgcccagcaagtgaactgtttcatccctggatggatgctttgagcatgtgctgatgaatctgatcagtgcctctaatcactcataagaaagcatgcccaattatgctttttttttcctggcaatattatataaaatgcatgtaacttattttcacataaactcagcagtgactgaatttcaaggggacctttcaaaggcctaaagtccttttagaactc

SEQ ID NO: 16223 - DNA, 1177 bp, Malus x domestica
  Predicted polypeptide sequence is orthologous to G137, G145
attttcttcatgttaccctcatctttttatcccttttggtataccctaaacacacagcctcctgaaagaaagtttgtctacctctgatcttaaccaagtagagagagagagagagagagagagatgggcagaggcagagttgagctgaagaggatagagaataaaattaacaggcaagtgacctttgccaaaagaagaaatgggctgctcaagaaagcttatgagctctcagttctctgcgatgctgaggttgccctcattattttctctagccgtggcaagctctatgaattctgtagcagtttcagcatgatgaaaacgcttgaaaagtaccaaagttgcagttatggttccctggaagccaacctaccagccaacgagacccagaacagctatcaggactatttgatgttgaaggcaagagttgaggtcctccaacaatctcaaagaaaccttcttggggaagatttgtcccacctgaacacaaaggagcttgagcatcttgagcatcaattggagacctctttgaagcaaattaggtcaagaaagactcagtttattctcgatcagctttctgatcttcaaaacagggaacagatgctagttgaagctaacaaagccttgaagaggaagctggaagaaacaagtgtgcatgctccagaaggaatggcatgggaagctgctggccatggccccaacaacattcagcaaactcggcttccttcccactcagaagccttcttccatcccttggaaggaaacaactccagttcccaaattggatacacccatatgggttcagataatgaaatgaatgttggaaatccgggccagtatgttaatggatatattcctgggtggatgctttgactttgattatgcatataatatccatcgtgacatataatatacatatacatatatatatgtatatgtatggaataaaattagcaatggatcatgttgatcaagcttttataatattttctgttatgatcttataattctatgcaacttgtaatgattcttgaaacaataagaataatatatatatatatatatatatatatataaatatatatatatgttttgtaagttgaattaatgtcattgaaaaacttctatgaaatgtatgagaccaatttgtatatataaaggtttacaatccttctttctt

SEQ ID NO: 16224 - DNA, 958 bp, Malus x domestica
  Predicted polypeptide sequence is orthologous to G137, G145
aggtaaagttgagctgaagaggatagagaataaaagtaacaggcaagtgactttttccaagagaagaaatgggctgctcaagaaagcttttgaactctcagttctctgcgatgctgaggttgccctcattattttctctggccgtggcaagctctatgaattctctagcagtttaagcatgatgaaaacgcttgaaaggtaccaaagatgcagttatagttccctggacgccaaccgacctgccaacgagactcagaacagctatcaggagtatttgcagctggagacaagagttgaggccctccaacaatctcaaagaaaccttcttggggaagatttggccaccctgaacacaaagaagcttgaggagcttgagcatcaactagagacctccttgaacaaaattaggtcaacaaagactcaatttatgcttgatcagctttctgatcttcaaaacagggaacaaatgctagttgaagctaataaagccttgaggaggaagctggaagaaacaagtgtgcaagctccacaatttatggcatgggaagctgctggcgatggccacaacaatattcagcaaacttggcttccttccaactcagaagctttcttccatccctttggaggaaacaactccacttcccaaattggatacgcccatttgggttcacataatggaatggatgttggaaatccgggccagcatgttaatggatacattcctgggtggatgctttgactttgtttctgcctaataataatatccatcgagatatatatgtggagaatgaaatttgcaagggatcattgatcaagcttctattttattttttgttgtgatctgttatttctctgcaacttgaaacaataagaatatatacatgttttgtaagttgaattgacgtcactgaaaaacttctatgaaatatatgaaacttaaaaaaaaaaaaaaaaaaaa

SEQ ID NO: 16225 - DNA, 993 bp, Malus x domestica
  Predicted polypeptide sequence is orthologous to G137, G145
acaaaataatatttttagtaactaaggacatggggagaggaagagtggagctgaagaggatagagaacaagataaacaggcaagtcacatttgcaaagagaagaaatgggcttctgaagaaagcttatgagctctccgttctctgtgatgctgaggttgctctcatcatcttctccaaccgtggcaagctctatgagttttgcagcagctctagcatgctcaaaacactagacaggtaccaaaaatgcagttatggtgcagtggatcaagttaatagacctgcaaaggaacttgagagcagctatcgtgagtacatgaaactcaaaggtagatatgagtccctacaacgaactcagagaaaccttcttggtgaggacttgggtccattaaacacaaaggaacttgagcagcttgagcgtcaacttgagggctccttgaagcaagttaggtccactaagacccagtatatgctggaccaactttctgaccttcagaacaaggaacaactgttaatagaagccaacagggatttgacaatgaagttggatgaaattagttcaagaaatcaacttagacaatcatgggaaggtggtgaccagggtatggcatatgcaacccagcatcaccatgctcaatcccaaggattcttccagcctttagattgcaatcccactttgcaaatggggtactctgcagtggggtcagagcagatgagtgctacaactaatgcccagcaagtgaactgtttcatccctggatggatgctttgagcatgtgctgatgaatctgatcagtgcctctaatcactcataagaaagcatgcccaattatgctttttttttcctggcaatattatataaaatgcatgtaacttattttcacgtaaactcagcagtgactgaatttcaaggggacctttcaaaggcctaaagtccttttagaactcatttcttgctttgagactacggttataaaatgttttcctctttttca

SEQ ID NO: 16226 - DNA, 633 bp, Malus x domestica
  Predicted polypeptide sequence is orthologous to G137, G145
gagagagagagagagagagagatgggaagagggagggtggaattgaagaggatagagaacaagatcaacagacaggtgacctttgcgaagagaaggaacggactattgaagaaagcctacgagctttccgttctttgcgatgccgaggttgctctcatcatcttctccaatagaggaaagctgtacgagttttgcagtagttcaagcacgctcaaaactcttgagaggtaccagaagtgcaactatggagcaccggagacaaatatatcaacaagggaggccttggagttgagtagccagcaggagtatttgaagctcaaggcacgttttgaagccctacaacgaaaccaaaggaatctccttggagaagatcttggccctctaagcagcaaagatcttgaatcacttgaaaggcagctggatatgtcgctgaagcagatcagatccacacggacccaatgtatgctggatcagctcacagatcttcagcgaaaggagcacatgctaaacgaagcaaataagaccctgaaagaaaggttgttcgagggataccatgcactcccactgaatgcaaatgccgacgagtacagccgcccacaaccccggcggcgcgggggaggtttctcctcccct

SEQ ID NO: 16227 - DNA, 1256 bp, Malus x domestica
  Predicted polypeptide sequence is orthologous to G142, G148
actagttctctccacagacagttcaccaaaccacccatttttgtgtaaccccaaatcctagagaagaggaatatctctctctctctctctctctgtctctatgcatatgggataacaaatacagagacaaaaagcacaatatagatttcatatttaatttgcaaaaggaaggggaaattgaagaggtgagaatatggggagggggagagtggagctgaagagaatagagaacaagattaacaggcaggtgactttctcaaagaggagaaatggtttattgaagaaagcctatgaactctctgtgctttgtgatgctgaggttggccttatcatcttctctagccgtggcaagctctatgagtttgccagcgctggtatgagcaaaacccttgaacgataccaacgttgctccttcactccacctgagaatagcattgaacgtgaaacacagagctggtaccaagaagtcacaaaactgaaagctaaatatgaatcccttcagcgaactcaaaggcatttgcttggtgaagatcttggaccactgagtgtgaaggagttgcaaaatcttgaaaaacaacttgaaggagctcttgcacaaaccagacaaaggaagacacagcttatgattgaacaaatggaggacctgcgcaaaaaggagcgtcaccttggagacctcaacaagcagctgagggtcaagcttgaggcagaagggcagaatctgaatgtcattcaaaacatgtggagctcagatgcagcggctggaagtagcaacttttctttgcattcttcacaaaccaaccccatggactgtacacctgaacctgtcatacaaatgggataccatcagtatcatcctgctgagggatcatctattccaaggagcttgactggtgagaccaacttcatccaaggatgggttctctgaaaaccttcaataccaaaaatgaaggatatatatttcatattttatctattattgcagcatcataaattatattttctaatatctatactttgcaagaatatatgactttaagaattggaatactgccaacatatatttacttcaagtatgactgacaagagatgtttgtaaatttgtaattatacttctagattcctgtgtttccttattcttatttggttttctttttacttttatttattgataattgcttgtatttttgggccctgacggttggattgtcaaggaccattcaattgagccttggtttacattaaaaaaaaaaaaaaaa

SEQ ID NO: 16228 - DNA, 698 bp, Malus x domestica
  misc_feature (617)..(617): n is a, c, g, or t
  Predicted polypeptide sequence is orthologous to G154, G627, G1011, G1797, G1798
gagagagagacaaagtgtggcctgaggataaagagagtgggcatccacaatcagataaaaatatccttctctgcgtttcccttctctgtgaatactattctagggtttctgatctagtttccatatttggattccttccaatccaataccgctgtgtccttgctgctcatttttaaggcaaagctaggacatggtgagaagtaaggttgagattaaaagaattgagaataacacaagccggcaagtgaccttctcgaaacgtcgaaaggggttgttaaagaaagcttatgagctttcggttctttgcgatgctgaagttgcagtcatcgtcttctcgcaaaaaggcaggatctatgagttctccagttctgacatgcaacggactataaatcgataccataaacatgaaaatggatcagggccaaccaacaaggttgaagtggaacaatatgtgcagcacttgaagcatgaatcagctattatggccaagaagatagagatcctagaagcttcccagcggtttatggcctagtttgatcatcatctcctgtatttttttctcatctgacattttattggattaggttttcctaaactctgaaatttgtatgtcttangaagcttttgggaaatgatctggattcttgccctgttgaagaactccaagagatcagtagccagctggagcgaagcttacg

SEQ ID NO: 16229 - DNA, 678 bp, Malus x domestica
  Predicted polypeptide sequence is orthologous to G184, G186, G916
gtccgagccagatcagaagcccctatgattactgatggatgtcaatggagaaagtatggacagaagatggcaaaaggaaacccatgtcctcgtgcatattataggtgcacaatggctgtaggctgtcctgttcgcaaacaagtacaacgttgtgctgaggacagaaccatactgatcacaacatatgaaggcaaccataaccacccactgccacccgctgcaatggccatggcatccaccaccacggcagccgccagcatgctgctttcggggtccatggcaagtgcggacgggatgaatatgaaccctaataatttgctagccagagcaattcttccttgctcatcgagtgttgccacaatttcagcctcagctccattcccaactgtcacattggacctcaccacatctccattacaattccaaagaccaaacaccccatttcaaatccctaatttcccagggcaaccccagagttttggggcagcttcacaacaactgcctcaaggttttgggcaggccctctacaaccagtctaagttttcaggacttcaattatcccaggatttaatggggtctactagttcacaacaacaacaaatgcagcaaactcagtcttcctcgtttgctgacacagtgagtgccatcacggctgatccgagctttactgctgctctc

SEQ ID NO: 16230 - DNA, 622 bp, Malus x domestica
  Predicted polypeptide sequence is orthologous to G184, G186, G916
ctgaatttgacgcaaagccagaaggctgatcagaacagtagcggtgccgaaggccatcgagtgacagtggaagaaaagaagcttatgaatggcaatggatcatcactagtggtgccgaggcagttcatggatcttgggttagctgctaaaaatggtgacgctgatgagcattcatagtcttcgtctgatgaacgaagtcatggcgaacggtttggatcgcttggagataatgtgaaggctgcagggcacagtgatgaccaaaggatcggttttgatcacgaaaagaaggatttcgggagacgaattgggagagaggagagcccagatcagccgtcacagagttgggggcttaacaaagttccgaggctcaattctccgaaagaggttggtcaaactgaggctacaatgaggaagtttttgtttgatgctttggaaacagtttggttgttttaagcttatgattagttaatcgttttaagtcaatgttatgttgctttcctataagatcgatttatgttttggtctttttgaaaagtgggagcatattatgtgattgactgtttaatatcagtttatgttatgagtcatatttgcagtctggaaaaaaaaaaaaaaaaaatcg

SEQ ID NO: 16231 - DNA, 618 bp, Malus x domestica
  Predicted polypeptide sequence is orthologous to G184, G186, G916
ttcgtatcgtcaaaagattaattaaattttatggacaaaggatgggggctcactcttgattctgactccttcggctacctcctcaacaagccgcccaccgccgcggttaagctcgaccaccacaacaacaagagaagcagtttttttggtggggaaaggatgttccagggaatggaattccccgtcaaacttggccgccgggaagagcaggatgcatcacagccgtccaatgacaacaaccggatggttgtggatgaggtggacttcttttccgatcgtaagaacaagctcaataccaatagtactgatgaccatcatcaggattcgaaatccaatggtgcagtcagtgtcaagaaggagaattggactggtttggatgttaatactggattgcagcttgttactgcgaacaccggaagtgatcagtcgatggttgacgatgggatttcttctgatcatggggttaacaaaagagcaaagaatcatgagctggcacagttgcaagtggaggtgcaacgtatgaatgctgaaaaccagaggctgaaagaaatgcttggtcaagtgaccaacaactacagtgcactgcagatgcatcttgctgcagtttgtcaacgacaa

SEQ ID NO: 16232 - DNA, 622 bp, Malus x domestica
  Predicted polypeptide sequence is orthologous to G189
caggtagaattagcaactataagaacaagagaaagtccttatggaagatagatttaccagtcgtagcctatgccttcgtctttcgatgatcagacctaagaaaggcggcctaattccgatcaaaaaaagagagaaattcccccagaaagggtagagccttagttacccgcaggtcataagctggtaaccagtggaagagcaagaactttcaggtgaaagaccctcactcgaactcagtaggaagccaagcacgcacgaaagaagcttcccgagctgctgcctttaccttcttcctggggaggggtctctagcacattataatgcgagctcggatgcggattcccttaaattagatttcgtgagattagatgggctgggctatgtcttcggtctggatgaatgcgagtgcacgaaaggtctgatcggctcataggtggaagacactaccttgaattagctcttttcctctttctttttcacaagcatgagtaggacttatagtcttggaaaagtcacccgactaagcaaagaaggaggacctagttaaggaagaatcgaccgaagtcagagaaagtgagccagccttccggaaacggtgaattcataatataatgtccttctt

SEQ ID NO: 16233 - DNA, 630 bp, Malus x domestica
  Predicted polypeptide sequence is orthologous to G192
atctcttagcttatcctcctcctttgctttccctttcctctctctcactctgtttctctctcctgtctctctctcttaatcaattggacaactcttctgtctcatcttgatccatttcttcctcctttttagtgtcatttgcttctgcagcttccttttctccatccccagaagaaaaaaaaaaaggaaaaaagaagatagaacatcaccaaggaggaggagcatggatgaaaccctttctccagaaccagactcagatgtttcaagaaatctcaggccagaaactcagccatccaaaagaaggaaggtggctcatgagaagactgttgtgacagtgaagataggagctaatgttgggaagctaaagaatgaagggccgccttccgatctttggtcatggaggaaatatggccaaaaacccatcaagggatctccttatccaagggggtactaccgttgcagtacatcgaagggttgctcggcgaaaaaacaagtggaaagaagcaaaaccgatgcttcagttctcataattacctacacttccagccacaatcatccaggtcctcctgatgtgaatgtgatctccactacccaacaagaacaagaagatgaacagacccaacaagaaca

SEQ ID NO: 16234 - DNA, 704 bp, Malus x domestica
  Predicted polypeptide sequence is orthologous to G194
agcaatgaagaagaagaacatcatgagcaacaaaagaccaagaaagagttgaaagcaaagaagacgagtcagaaaaggccgagagaacccagatttgcattcatgacaaagagcgaagttgatcatctggaagatggctacagatggagaaagtacggccaaaaagctgtcaaaaatagcccctttcccaggagttactatcggtgcacaagtgcatcatgtaatgtgaagaagcgagtggagcgatctttcgacgatccgagcattgttgtaactacttatgaaggccaacacactcatcgcagcccactcctgcctcgcccaactctccctgcggcttctgcttttccagctaataactttgagatgccattaatccccacaagaaccctatttactcatgactatcaacaagtacaaccatttgcagataacaactcctcttcgccttcatcggcaccaattaattttggtgattattatgtgaatggctcttcattgtttacaaatgctactagtaccacgggctttcttcatcccgaaaggcggttttgctctccggcaaccggttctgctttgttagctgaccatggccttcttcaagacatagtcccctctcatatgctgaagcaagagtagaagatatatacccttatatatatatatgatcatcatcagatagtgagatcattccaatccatcag

SEQ ID NO: 16235 - DNA, 682 bp, Malus x domestica
  Predicted polypeptide sequence is orthologous to G194
aaagagcgaagttgatcatctggaagatggctacagatggagaaagtacggccagaaagctgtcaaaaatagcccctttcccaggagttactatcggtgtacaagtgcatcatgtaacgtgaagaaacgagtggagcgatctttcgacgatccgagcattgttgtgactacttatgaaggccaacacactcatccgagcccactcttgcctcgcccaactctcacttcagcttcttctgttgcttctgcttctccttttgcacctaataattttgccatgccattaatccccacaagaaccctatttcctcatcactatcaacaagtagagccgtttgcagataactcctctccaccttcatcagcaccttttaattttggtaattatcatgtgaacggctcttcgtcgtctctaacaaatgctactagtactaccaccggccttgttcatcccgaaaggcggttttactctccagcaaccggttctgctttgttagctgaccatggccttcttcaagacatagtcccctctcatatgcttaagcaagagcagtagatgtatgcccatatatatatatatatatatatatatagacataaagatatggatattatcatcatgagatagtgagatcctcccattagagctacttaattatgtactaatttagcttgcttactg

SEQ ID NO: 16236 - DNA, 726 bp, Malus x domestica
  Predicted polypeptide sequence is orthologous to G197, G255, G664
cctggacgatgaggcagacgaggacttcgagttgttcccgcacacttcatccgtcgcaaaaaccaaaaagccagacataaaccaacaacaaaggcaacggctttttggctacaactaattattcttcttaaagctttcaacttttttccatttattttttcaaatgggaaggtctccttgctgtgagaaggctcacaccaacaaaggagcttggaccaaggaagaagacgaccgcctcattgcctacatcagagctcacggcgaaggctgctggcgttcgctgcccaaggcggcgggcctccttcgatgtgggaagagctgcaggctgcggtggatcaactaccttagacctgatctcaagcgtggcaatttcacggaagaagaagatgagctcatcatcaaactccatagcctcctcggaaacaaatggtctttgatagctggaaggctgcctgtaagaacagacaatgagataaagaactactggaacacccacataagaaggaagcttttgaccagagggattgaccccacaactcacaggccactcaatgagactcctcaggaatctgcaaacacaatttcttttgctgctgcttctgcaaatatcaaagaagatgatgaaaaaatctccataaccaatgggcttgttcgcaagcattcaacaaacccagctcaggaaaggtgccctgacttgaatcttgagcttcaatcagccctccctgc

SEQ ID NO: 16237 - DNA, 507 bp, Malus x domestica
  Predicted polypeptide sequence is orthologous to G198, G1328
gattcattcttctctctctctctcactaaactcttcataattttgacccatgtttctcaattaatgtacatgaacagttgagcacacggtacttttaagcttgtgggcaccggagcactgggattttaaaagcaaagccagagagttttttcaaacaaaaacttgaacaccatgggaagagcaccttgctatgacaaaaatggcctcaagaaaggcccgtggacgccggaggaggatcagaagctcatggattatattcagaaacatggttatggcaactggagaaccctcccaaagaatgcagggctacaaagatgcgggaagagctgccgtctccggtggacaaactatctccgaccggacatcaaacgaggtcggttttcattcgaagaggaggagacaataattcaactccatagcatattgggcaacaaatggtctgctattgctgctcgtttgcccggaaaaaccgacaacgaaatcaagaactactggaacacccacatt

SEQ ID NO: 16238 - DNA, 507 bp, Malus x domestica
  Predicted polypeptide sequence is orthologous to G207, G227, G242
cgttgctgtcggctcctccatgtccgaagatttgtgctccgacgtccatgaccacccgccacacaaaagatccgccagcgtcggtgccgtttcgggtacgggtctctattttaacccgggtagcccgtccggatccgatttgagcgattctagcttgcacggcggtgtctctccctcgtctcaggtcttcaccccccttgcgagacccgtatctcctcccattgctccgccgccgatggaggccgcgacatcagctgtggccgttgatccacccacctcgctcagcctctcgcttcccggatccgagtcggagtcgtgtgacgggtcgaatcatatggggtccggattcggatccaatccgattgttggtcccacccaaatggtagagcaaccacatgaggtagcagctccaccgccggtggtaggattgctgccgccgccgcgttcgagcaatttgaacaacaatcagcagtttttcagctcggagttcctggatgtgatgcagga

SEQ ID NO: 16239 - DNA, 624 bp, Malus x domestica
  Predicted polypeptide sequence is orthologous to G207, G227, G230, G242
actggtcgctgatcagcaagtcgattcccggtagatccggcaagtcttgccgtctgcggtggtgcaaccaactttctccggaggtggagcaccgccccttcagtcctgaagaggacgacaccataatccgggcccacgcccggttcggaaacaagtgggccaccatcgcccggctgctcaacggccggaccgataacgccataaagaaccactggaactccacgcttaagcgcaaaagctcctccatgtcggaagatttgagctccgacgtccaggcccacccgccgcacaaacgatccgccagcgtcggcgccgttccggttacgggtctctatttcaaccccggtagcccgtccggatccgatttgagcgattcgagcttgcccggcggtgtgtctccgtcgtctcaagttttcactccctttgcgagacccctacctccacccattgctctgccgccgatggaggccgtgacatcggctatggccgttgatccgcccacatcgctcagcctttcccttcccggatccgaatcgtgtgatgggtcgagtcatatggcgtccggattcggaaccaattcgattgtcgggcccgcccagattgtacagcaagcgccagaggtaa

SEQ ID NO: 16240 - DNA, 649 bp, Malus x domestica
  Predicted polypeptide sequence is orthologous to G207, G227, G230, G242
cactagaaactctcaactttcaaatttcaaaggattacagagaaattcaaatttaaaagaaaaaaaaaagaagattaaggggagagaaagagtctgtgagttaattgcgatggcggtgagcagaaaagatatggatcggatcaagggtccatggagccccgaggaggacgactccctgcagaagctggtgcagaagcacggccccaggaactggtcgctgatcagcaagtccattcccggtcggtcagggaaatcgtgccggctgcggtggtgtaaccagctgtcgccacaggtggagcaccgggctttcacgcctgaggaggacgacatgatcatccaggcccacgctcggtttgggaacaagtgggccaccatcgcccgcctcctcaacggccggaccgacaacgctatcaagaaccactggaactccaccctcaagcggaagtgctccgacggcgggggcgtcgatttgaatggagggtacgatggtcattttctccgtgaccacgagcaaccgccgctgtaccggtcggttattgctcggtcgggcgtgccagtttcaacagggttttacttgaccccgggataatcctgtatggggccgaatcctaccaccgccaactccctacccatgccccccctccacctc

SEQ ID NO: 16241 - DNA, 487 bp, Malus x domestica
  Predicted polypeptide sequence is orthologous to G212, G247, G676
gcaagtggaatcgtgtcaataaagtcacaggattgaagaggagcggcaaaagttgcagattaaggtggatgaattatctaagtcccagcgtgaagagaagtgacttctcggaggaagaagatgatctcatcattcgactccataacctcattggcaacaggtggtctttgattgctggccgtgttcctgggagaactgacaatcaagtcaagaaccattggaacagtcatttgagcaagaagctcggtgtcggttcaaaaagaggaaagacaaaaaccaagacttattccgactcaaaacgagcaaaaaaataatttctgcataccctcatcagagtcaaactccgagttgcaaccacttcctaattccgattccaattccaatatttctggtgatcatgaagctgcagctaccattgatggatttgatgaggaaatgatgaacatccagaaccacattggctctaaaagtggttggtttttgtggc

SEQ ID NO: 16242 - DNA, 389 bp, Malus x domestica
  Predicted polypeptide sequence is orthologous to G214, G680
agaattctcttcaaattccttctgtggaggatcaacaattggagccggaacacttggaagctgtggatgctcagcatttagcttcacaatcaccaaacaggtcatcatcgcactctgataatggaggtgcagagccaaatacagaattgaagtctgctgatgacgagaaggctgtagcatcaactgctcaagttaatgattcagacaatgcaaagagtagaaaacaggttgaccattcttcgtgtggctccaacacaccttccggcagcgacatagagacggatgcattagagaagcatgagaaaagcacagaagaaccagaagaaccaaaagaaccaaaagaaccaaaagaacttgatctaaatctgttagcatctgattctaattat

SEQ ID NO: 16243 - DNA, 626 bp, Malus x domestica
  Predicted polypeptide sequence is orthologous to G214, G680
acatcaatgatccatggaaagaggtttctgaagagggacggatggcctttcaagcgctattcgcaagagaggtactgccccagagtttttcaccgccttcacactgcctcacagttaatgagcatcagtatgctacagaagcagcaaatcaaaattctgacgagaaagataggaatgcatctgcatcacaatttgacttgaaatcatggatgtcatttccgtatcctccagaagcggagaaaagtgtgtcaccagcacgaggcagcaacactgaagggctactgacactaggacttagccaagggaaactcaaggcccgtcgaacaggattcaagccttacaagaggtgctccgtagaggccaacgagaaccgggtggccaatgccagcagtcactgcgaagagaaaggcccgaagaggttacgcttagaaggggaagctcaaacttgacattccatattgcgtgcaaaatcaacggaaacctttgtttttgcacgcaggttgtattttccgctcctttatatagttcgtttgtgttttaatttcgagtccagcacatcagaaacttgtctttggcgtgtgtaccataatctatatacatttgatcgtttcaccaaaaaaaaaaaa

SEQ ID NO: 16244 - DNA, 610 bp, Malus x domestica
  Predicted polypeptide sequence is orthologous to G217
atatccagaaggcagcaagcattgagaacaaggttaaagttcgcacatatggttatgagatgcgggctaaagagggtctctggccaaaaattgaggaaacgtttaagcagatcgacactgctgcaaaagaacttgagtgctttaaagctttacagaagcaagaaagattagcggcaacacaccggataaataatatctgggaggaagttcagaatcaaaaggagcttgagcggcaactacagaagcggtatggcaatcttgtagctgaggtggaaaggggacagcagcgcatggatgaactcagagcagaagcagaaaaacaagaaattgcagccaggaattctgatctggagttggctgaggctacagcaaatgtgactgttcaacagacaactgaaaatcctgatcatgtaactgcttcagacgagcctggaaatgctgttcccggtggtgcatctcatgttgaaggaacaaatcaacaaatggatggtgtgcaagaacaggcttcaacaggcccagaaggtgatatggacaatgatgccaaaaaggttcatgcgacgccagcggatgatgtaaacttacctgataacatgccttctgctgttgaggg

SEQ ID NO: 16245 - DNA, 659 bp, Malus x domestica
  Predicted polypeptide sequence is orthologous to G249, G1322
aaacgcacaaacactgaaataaaatggataaaaatccattcaatagttcatcccaggatgttgaagtgagaaaagggccatggaccatggaagaagatttgattctcatcaactatattgcaaatcatggtgaaggtgtatggaactccctagccaaagctgctggtctcaaacgtactgggaagagctgccgactccggtggctgaattatctgcggcctgatgttcggagaggaaatatcactcctgaggaacaacttttgattatggaactgcatgcaaagtggggtaacaggtggtcgaaaatcgcaaaacatctaccgggaaggactgataacgaaatcaagaactattggaggactagaattcaaaagcacattaagcaagctgagaatattacaccaggacaaagctctgaggtcaatgatcaagcaagcacaagtcaagtgtcaatctctaacactgtggacacaatggatatttcccactccgcaccaacacaccaagcaaatatggatgcttatcctcctcctttgcctgctgatcaatctaatgataactactggagcatggaggatctctggtctatgcaactgctaaatggagagtaattaaacaaccgatttcatatgaaaacttaagtttgtccatatgaaaac

SEQ ID NO: 16246 - DNA, 534 bp, Malus x domestica
  Predicted polypeptide sequence is orthologous to G264
gagcctttacaaacaaaaatatagctgacaacgacaaactcaaaacttcctcccaagaagccacacataacaatcaagcgcccccactggttccagttagagtaaacgatgtcttctgggaacagttcctaactgaaagacctggctgttcagagaatgaagaagcaagttctgattataggggaaatccatttgatgagcaagatgatggaaggttagaccatggaatgtccagaaatgtcgaggatgcggaaacactcactctttgagtaccagagtcgtggcgaagccctgatccaggttcacaagaaagcgctctccagtctcccttgatttataagattcaccttatataattctgaaacttgacatgaactgcctgttattgattggaatgagttcatgcaccaaattgcaattagttcatagtcatcactggctagtgttcattggcatgttagtgtattctgatatagccgcatttagcagtgtagtattgatacatacgttgtaacacaaaaaaaaaaaaaaaaa

SEQ ID NO: 16247 - DNA, 631 bp, Malus x domestica
  Predicted polypeptide sequence is orthologous to G268
aaggagttgaattgcgtggtgccgaggccgaaaggctatcagactcgaataccgtggcctcagagccgagataaggtgtggttcagtaatgtaccccatactcgactagttgatgataaaggtggtcagaattggatacgggtagaaaaagataaatttgtttttccaggaggtggaacgcagttcattcatggggcggatgaatacttgaatcagatttctgatatggttgctgacattggatttggtcacaaaactcgagttgccttagatattggttgtggagttgcgagttttggtgcctttttgatgcagcggaatgtgaccactctgtcaatagcaccaaaagatgttcatgagaatcagatacagtttgcattagagcgtggtgtacctgcaatggtggcagtatttgctactcaccgcttgttgtatccaagccaggcttttgacttgatccattgttcaagatgtagaattaattggacccgagatgatggaattttgcttctcgaggctgacaggttgctaagagcaggaggatactttgtttgggcagcacaacccgtttataaacatgaagatgccctacaagaacaatggaaagaaatggagaacctgactactcgca

SEQ ID NO: 16248 - DNA, 390 bp, Malus x domestica
  Predicted polypeptide sequence is orthologous to G268
ggagctgggggaggtttcggtggaggagctggtgctggcggtgggcttgggggtggattgccttgaagacgtacgtgtgcatgaatactctacgattcatttctccatgcacttccaaatcaaattatatatctatcttgaattactaatttagtacgtacttatgttaaggacagtcttgttgttttgtgtcaactgtaatgtgtaccatcgttgctttagcaaccaagtattttaatcgtgatgacaatgttcgaaccctaatttgttgaagacacaaagctgatcttcgtatgattgttaattacccaattgtgctaatgtatccatgcatgtgttacagtgttattataagaaacttttatctgctcaaaaaaaaaaaaaaaatgc

SEQ ID NO: 16249 - DNA, 402 bp, Malus x domestica
  Predicted polypeptide sequence is orthologous to G268
gcatccggtctcttctctattgagaaaacgaggtgtaatatttcaaccatcatgctcgagatggatcgaatgctgaggcctggcggacgcgtttacatacgtgactcagtatctgtaattgctgagcttcaagaaattgcgagcgccgttggatgggtgcctgcgctacatgacaccggagaaggaccccatgcaagctggaagatcttaatcggtgacaagcgattttgatcggattcgggtgcaaacaagtcgatgtatttttctgtaaaaggatggaaatctacccgaaatcgcaccattgaagagaaggcactgcaactaacttattgccattgttttacgctgtgtaatttgtaagattagcaagaacaaataaacaatctcgcttccttttttttg

SEQ ID NO: 16250 - DNA, 584 bp, Malus x domestica
  Predicted polypeptide sequence is orthologous to G268
atctgaatcgggatgaaggaaccaaacctccattatgtgatccaagtgatgacccagacaaagtttggtatgttgatctgaagtcatgcattacaagactccctgaaaatggttatggagcaaatgtcacagcatggcctgcgcgtttgcaaactccccctgatcggcttcagagcatacaacttgatgcctatacatccagaaaggagctcttcaaagcagaatccagatataacgatgaattaattggaggttacgttcgtggtttaaaatggaagaagtttaaattaagaaacgtaatggacatgagagctggctttggaggatttgcagcggcactaattgaacatgatttgaattgctgggttatgaatgtggttcctgttagcggccccaacaccttacctgttatctatgaccgtggactcattggagtaatgcatgactggtgtgaaccatttgatacgtacccacggacctatgatttattgcatgcagccggtcttttctctattgagagaaaaagatgcgatatctctacaatcatgcttgagatggaccggatgctaagacctggtggtcgt

SEQ ID NO: 16251 - DNA, 286 bp, Malus x domestica
  Predicted polypeptide sequence is orthologous to G271
cgcattttttttttttttttttggagtaaagtttcatttaaatttctgaattaatttacttaatcactatatcctgagtctcctcacatccttgaaaggttggaaagaattcagcaagtttcttcccctggcacctgacctttggtgtatatatgaaggttcaacccaatctcagcgagccgtggacgtgtctgaaacatagaagagccatatacacaaagactaaaaaaggttctcccacttgaagaagtgccttccatgcgaagtgctaaaaagagacaagcgc

SEQ ID NO: 16252 - DNA, 696 bp, Malus x domestica
  Predicted polypeptide sequence is orthologous to G274
gcttacttcattgaaacagtgttcccccgaccaaaaagaaaaaaaagaactgaattgaaacagtgcgtgcaaacacacgggaagaacaacaaaagcatcctcggcctcatcgtaccttgtctttccagttaaacaacgaaagaagaacaacggcagagccgctcgccccgcctccgaaatcaaattcgtgtcagaattttagccgctgcccacgatttctgccgcatttcctctcataaagttgtcgtcttttttgttttgtcgtttgttttttcttggatgtctccgtctgtgtcgtgggttacggattgctggaggtgaaagatgcgtttgatttgatccgacccgaaaaagattcgtgcttttcgctccctgagatccgcacatcatggcgacaaaagggaactcaggagataacaggagtcgaagctccatgtcaattgtcattgtagctggcctgtgttgtttcttttacatattgggtgcgtggcagcgaagtggttttgggaagggagatagcatagctgtggagattaccagacagacagactgcagtatcctatccaatctgaattatgagacccatcgtggtgggattgacgattctgaaggagttgtcaaggagttcaaatcatgcggaaatcgctatattgattacactccctgccaagatcaaatgcgagcaatgactttccc

SEQ ID NO: 16253 - DNA, 2375 bp, Malus x domestica
  Predicted polypeptide sequence is orthologous to G274
cagattttaaagctttttgagatttttcagaggctttgcgacacgtctccaccgccattaccatctcagcactgaatcctccatcaccactctctctctctctctacatcataatatcatattctctccctcatcattcacacagaaaaaggagagaaagattttcccttttttctctgatacgtcggatagatctggaccctctgcttgctttttcctttaatgtaattggcgctaaatggctccgaaagcgaatgcagacggtcggactaggagctcggtgcaaatttttattgcagctggtctgtgctgttttttctatattttgggtgcttggcagagaagtggttttggaaagggagatagtatcgctttagcgatcactaagaatgaggctgactgcaatattattccaagtctaagttttgattcccaacatgccggtgaagttggaaatatcgatgaatctgaatcgaagcccaaagttttcgaaccgtgtcatcatcgttacactgattacaccccgtgccaagatcagaagcgtgcaatgacattcccaagggaagatatgaattatcgagagaggcattgccctcctgaggaagaaaagttacattgccttattccagcaccaaaggggtatgtaactccattcccctggccaaagagccgtgactatgtaccatatgccaatgcaccatataagagcttgactgttgagaaggctgttcagaactggatccaatatgagggtaacgtatttcgattccctggtgggggaacacagtttcctcaaggggcagataaatatattgatcagcttgctgctgtgataccaataaagaatgggacagtaagaactgcactggacaccggttgtggggttgccagttggggtgcatacttgttgagtagaaatgttcttgccatgtcgtttgcgccaagagattcccatgaggcacaagtccaatttgctcttgagaggggtgtacctgcagttattggtgttctgggtacaataaagctgccctatccatccagagcctttgacatggctcattgttctcgttgcttaattccatggggaataaatgatggaaaatatctcaaggaagttgaccgagttcttaggcctgggggttattgggtgctttcgggtcctccgatcaattggaagaataattaccaagcatggcagcgtcccaaggaggatcttcaggaggaacagagacagattgaagaagctgctaaacttctttgctgggagaagaagtctgagaagggtgaaactgccatttggcagaagagggtagactctgattcatgtggagacagacaagatgattcccgtgctaacttttgtaaagctgatgaagcagatagcgtctggtataagaaaatggagggatgcataactccataccctaaagtttccagtggggagttgaagccgtttccaaaaaggctttatgctgttccccccaggatttctagtgggtctgttcctggagtttctgttgaggactacgaggaggataacaacaaatggaagaagcacgtgaatgcttataaaagaatcaataaactaatagacacaggaaggtatcgcaacattatggatatgaatgctggtttgggtggttttgctgctgcaattgaatctccaaaattgtgggtcatgaatgtgatgcccacaatagccgagaaaaatacgctgggtgttgtatatgagcgaggattgattggaatctaccatgattggtgtgaaggtttctctacttacccaaggacatatgacctcattcatgcccatggtgttttcagtatgtacaatggaaaatgcaactgggaagacattcttctagagatggatcggatcttgcggccagaaggtgccgtcatattccgtgatgaagtcgatgtattaattaaggtgaagaagatagtaggaggaatgagatgggatactaaactggtggaccatgaggatggtccccttgtaccagagaaggtattggttgctgtgaagcagtactgggttggaaactccacctccgcacaatgaatgccttaaaaggactgcctcgaggcctcggcgtggatctaagctggcaatgttctctgttacaagtcctcacagggatgtgtatttttccagtgctcacttttgctgcccgagttcatacttcgtaaggaggagggcttacacaatctatgttcgttaactatcttccgccacgttcctttgtagtaattttcaagtaaacaaagctacagagctacaatgcttgtatgtttagggtgtcattcattttacaaaaccccttttttattattgaaattttaacgaaaaaaaaaaaaaaaaaaaaaaaaaa

SEQ ID NO: 16254 - DNA, 707 bp, Malus x domestica
  Predicted polypeptide sequence is orthologous to G275, G837
atctcagtggcctctgcaatggccatcaaggttgcagaaaccaccatactggttaaagtctcagcttgatgttaatgggaaatccgccccagaagatttcgtttctgactacaagcattggaaaaaagttgtttctgagacctatttgaatgggatgggaatcaactggtccactgtaaggaatgtcatggacatgagagctgtatatggggggtttgctgcagcactaaaagacttgaaagtatgggttatgaatgtagtcccagttgactctcgtgacacacttccaataatctatgagcggggtttaattgggatatatcatgattggtgtgaatcgttcagtacctaccccagatcttatgatcttttacacgcagatcatctattctccgtccttaagaaaagatgcagcttagtggcagcgattgcagaagttgataggatactgaggccagaagggaaactaattgtatgggacaatgctgaaaccttaaatgagattgagagtctggctaaatctctgcaatggaacatccgatttacttactcgaaagacaatgagggtttgctgtgcattcagaagacgttttggcgtcctgcagagaaggagaaaattttgtcagccattgcttaaatgcttcaatctgcgtctttgacggcctaaggcttagtcaatactggtattgtagcccgttaagtattgt

SEQ ID NO: 16255 - DNA, 535 bp, Malus x domestica
  Predicted polypeptide sequence is orthologous to G275, G837
ttttttttttacaatagaatcgaaatcctcagatattacataaaccaatagtttggtttttcttccatcaataaccagtacggtaatattacagtggaattccaaacaccgatctcccgacaacgaaaacaaaatattgtaaacaaaaaaaatgaacagactacaagccctaactaaaacgaaacaaaaggctaatataaccatgaatttcaattagcaaccaaaacaaaatataaatgggtaactattatatcctcagcaacgccagcagccactgccgaccaccacgacttccgaccaccacgcttaagcaattgcatacttgagtgtctccgactctttgggccgccacatggacttctgcacacaaagcaatccctccttgtccttcgaatacgtcaggctaacctcccactgcatcgacctcgccatgttctccagctcgtaaatagtctcaacatcgtctcgcacgatcagctttccctctggtcgaaggattcgatcaacctccgcaactacagccactaaattgcac

SEQ ID NO: 16256 - DNA, 633 bp, Malus x domestica
  Predicted polypeptide sequence is orthologous to G275, G837
ctctgatgttttcctcctttatataacaattataaatcagagagacacccccacactgagtgaccgaccagctctctctccctctctctctctctctctctccacaaaatagtaacggagtgagaagcagcaagaccctacacttcttcaatcacccagtgacccaagtgatttaataacttgggatatcgatcttcacatcgaaacgatggctgtggggaagtattcccgagttgatggaaggaagtcgtcgaattgttgttcaacgactagtctggttgtttttgtagcgttttgtttaattggggtctggatgttgatgtcaacggttgttccgattcagaatcaagggtcatcatctgaggagaccatggatgaggtaaaccggcaagttataactgaaaaaaattcaaagcaattcgaagacagttcgggggaactatcaggaactttagcaaaagaggatgaaaatggcagtggtgaaagccatttggatattgagaatgaccaaaatgttgaggatgggtctgtgaatacaacggaagaaaaacaggaagaagtggtttcaaaggagggatctgaggagaagactgagccagaaagtgacaatggtggtgagggaaatcagcaaga

SEQ ID NO: 16257 - DNA, 627 bp, Malus x domestica
  Predicted polypeptide sequence is orthologous to G275, G837
attttttttttctcttggtttcttgtcttttcttttcctttcctttctgtttctttcttttctaattggaggtgtttggagatcggagaatgctggaataatccctcaacagcaacgcagaggtatcagatctgcccaagcaaccaaacaaagaagcaaacaaggtgtagattatttgagaacaatcgggtctgtgatctgcttctgggtcgaacatggcgacagggggaaaatatactagagtagataataggaggccgtcctccgctagtggttgctgctccaccgtcaccgttggggtgtttgtggccttgtgcttggtcggggtttggatgatgacctcctcctctgtagttcccattcaaaatgtagatgtgccctctagatgagagtaagagtgatcgtcgtgacccttggcacccataagttctgcgtctaagcactaacgaatgaaatccatgcactgtcttttagaaataagccggctgacttcatctatgacctcacataatagaaaaagctaccgagagtgcctgcccatccgttgtggaaaaccttccaggaaaatcccctattagtccataccgaggaaatcgttgtcgtagacccacatcccgacatcccccg

SEQ ID NO: 16258 - DNA, 506 bp, Malus x domestica
  Predicted polypeptide sequence is orthologous to G275, G837
tggtgacaaagtcatacctgaatggaatggggattaactggacatctgttcggaatgttatggacatgagagctgtgtacggaggatttgctgccgctgtgaaagatttgaaaatttgggtcatgaatgtggtcacagtagactctccagatacactacccataatttacgagcgtggtttatatggtatgtatcatgattggtgcgaatcatttagcacgtatccaaggtcttatgatcttatccattccgaccatctgttttccaagcttaaaaagaggtgcaatttagtggctgtagttgcggaggttgatcgaattcttcgacctgagggaacccttatcgtgcgagacgaggttgggactattaatgagctggagaacatggtgaggtcgatgcagtgggaggttcgcatgacctattcaaaggacaaggagggattgctctgtgtgaagaagtccatctggcggcccaaagagtcggagacactccagtatgctatcgct

SEQ ID NO: 16259 - DNA, 673 bp, Malus x domestica
  Predicted polypeptide sequence is orthologous to G275, G837
caaagtgcctgttaatgcaacaaaacgtgggtctgaatggcctgaacaatggccggcgaggttggacaaggcaccttactggttgttaagttcccaagttggtgtttatggaaaacctgctcctgaggatttcacttcagacaatgagcactggaaacgtgtggtgacaaagtcatatctgaatggaatggggattaactggaaatctgttaggaatgttatggacatgagagctgtgtacggagggtaagaaaaatcgttccttgattgtcatgaatagtgtgttttgatgcatggaaaaccaccatctttgttataatttgtgctttactgtttatctttattatttttcttgaccttgccaaagaatatgtacaagtgagatgttgagttagaggcggctgcttctttactttttttacctgtgacttctggttgtgcttgcagatttgctgccgctttgaaagatttgaaaatttgggtcatgaatgtggtctcggtagactctccagacacactacccataatttacgagcgaggtttgtttggtatgtatcatgattggtgtgagtcatttaacacctatccaaggtcttatgatcttctccatgccgaccatctgttttccaagcttaagaagaggtgcaatttagtggctgtagttgcggaggtt

SEQ ID NO: 16260 - DNA, 534 bp, Malus x domestica
  Predicted polypeptide sequence is orthologous to G275
ttcacaactctcagatctctctctctctctctctctctaagacaaccaaagctttcagtaccagctgcttcaaacttcgctagctctcagctctcttcagggcgttctgcgtacgtcgtcgagtccgtacaaatggagaccaaaaggcgtacttcgacgagtagtggtggtgctgctgtcgttcaactagtcgaagctacgtttggtcagctcttgctgctaacgtgcgcctgggatgctcttcttgctaatctgctcaccgcctctgccttgctttctttcgctcaggatcctttcgtgctctcagcaacttgtggacagaaaagtcatggagacaatgagagtgagcattccaactccgaagcagttgatggggacgaagatggagacgaagagaaaaacaatgacggtggctttggagacactgaagaggagctatcttcggaagatggaggcgctgggaacaaccctaatgggaaaagcaacaactccaaagccgggcccggaagagaggatggcgaagtaggcgaagta

SEQ ID NO: 16261 - DNA, 619 bp, Malus x domestica
  misc_feature (534)..(534): n is a, c, g, or t
  Predicted polypeptide sequence is orthologous to G280
accttttaaatcctcaccttctttcctcatccgctctgcctgactgaacttcccaccaaacaaacagtctctctctctctagaaaacggtttcgctttctctctctagaaaacggttaacagtccccatctctcagtcagattctagtgaggaagctcccatggcgacggagaactccaacaatccactagtaccgccgccgccagttccctctctcccccagtacccagagatgattatggcggcaatcgaggccctgaacgacagcaacgggtcaagcaagtccgcaatcgcgaagcacatcgagtcaacgtacggagatctgccggaatctcacgtggccctcctcgcgcaccacctcaacaagatgaaggacaccggcgagctcgtcctggtcaagaacaactacatgaagcccgaccccaacgcgccgcccaagaggggccgcggccgtccgcccaaggccaagactccagtcccagctggcactgtctcctccccgcccaggccacgtggcaggccccccaagcccanggaccccttcgcaccgccacctcagcccaagacacattccggaactggaaagccacgtggccgccctcccaaaaaagccaaaacg

SEQ ID NO: 16262 - DNA, 699 bp, Malus x domestica
  Predicted polypeptide sequence is orthologous to G291
ctcgagaacaacgtatccccatggacacgccgccgagcgtggcgaagccgaaggcggacccgacggccgacgccatattctactacgacgaggcggctcaggtcaagttccagcaggagaagccctgggccaacgacccccactacttcaagcgcgtcaagatctccgccctcgcgctcttgaagatggttgtgcacgcccggtctggcgggaccatcgaggtcatgggcctcatgcagggcaagaccgacggcgacgccattatcgtcatggacgcttttgctttgcctgttgaagggactgagactagggttaatgctcaggctgatgcctatgagtatatggtggattattcccaaaccaataagcaggcggggcggttggagaatgtggttgggtggtaccattctcatccgggttatggatgctggctctcgggtattgatgtttcgacgcagatgcttaaccagcaatatcaggagccctttttggctgttgttattgatccaactcggacagtgtctgctggaaaagttgacattggtgcattcaggacgtacccagatggatataagcctccagacgatcctgtctccgagtatcagaccattcctctgaacaaaattgaggactttggtgttcactgtaaacagtattattctctggatatcacttatttcaagtcttctcttgacactc

SEQ ID NO: 16263 - DNA, 616 bp, Malus x domestica
  Predicted polypeptide sequence is orthologous to G307, G308, G309
gctcgcccaattggctgaaaccatccacgtcgagtttgaatacagaggatttgtggcaaacagcttggccgatcttgacgcgtcgatgcttgaactcggaccgagtgaggttgagtcggtggcggtcaactcggtcttcgagttgcacaagctgctggcccgacccggcgcgattgagaaggtgttatcagtggtgaagcaaatgaagccggagattgtgaccgtggtggagcaggaggcgaaccacaacggtccagtgttcatggaccggttcaacgagtcgctccactattactcgaccctgtttgactcgctggagggatcggcgaacagtcgggataaggtgatgtcggaagtgtacttggggaagcaaatctgcaacgtggtggcgtgcgaaggggtggaccgggtcgagaggcacgagacgttggcccagtggcgagcccggttcggctcggcagatttcgtcccggttcatctcggttcgaacgcgttcaagcaagcgagtatgctgctggcgttgttcgccggcggagatgggtaccgggtggaggagaacgacgggtgtatgatgttggcctggcacactcgcccgctcatcgccatctcggcttgg

SEQ ID NO: 16264 - DNA, 657 bp, Malus x domestica
  Predicted polypeptide sequence is orthologous to G307, G308, G309
cgtacttcgctgaagctctggctcgtcggatttaccgaatataccctcatgattgcctcgattcttcctactcggacattctccagatgcacttctacgagacctgcccctacctgaaatttgctcacttcactgccaaccaggcaatactcgaggcttttgccacggcgaccagagtacacgtcatcgatttcgggcttaaacaggggatgcaatggccagcgctcatgcaggcgctggcactaaggcccggtggcccacccgtgtttcgcctgacgggtattgggccgccgcagcccgataacaccgacgttctgcagcaggtgggatggaagttggctcaattggcagaaactattggggtcgagtttgaatttcgaggattcgtggccaatagcctggctgacctcgagccgtctatgcttgacatccgtcaggacgaggccgtagcggtgaattcggttttcaagcttcacggtctcttggctcgagccggggcggtggacaaagtgttgtcatcaatcaaggccatgaagcctaaaattgtgactattgtggagcaggaggcgaaccataacgggccggttttcttggaccggttcacggaggcattgcattattattcaagcttgttttgactctctggagggatcgtcc

SEQ ID NO: 16265 - DNA, 643 bp, Malus x domestica
  Predicted polypeptide sequence is orthologous to G312
cacgaggactcaatatcaagattcaaatttacaaacagaattacagacaacaaagggggcagaacctttttacccctccatttttcaatgccattttttttttattttttttttttacaattagtcatatttgagtctcagacctgtaaagaaagccaaaaaacggaggaaggtgaaaaaaactagtaccaaactacaaaattaacaagcaatttgtgacccaaaaagctcaaaattaacactgatggatggtaattactaatcctaagtttgtcactaaggcagagtcttgagtttcatatctgattgccgtcaatggcgtaccgaaactaacaggctcccgcccagttataaaagacctggcgaaaaaccgataacccgattccgaaatcgaagcaaaacccattaacgccatgaagaaactgtgaacaggggaacttcactccaggatagagagagaaacccaggtggagattcctttagagaatacaaagaactgtaattgtagttccagagcaggattttagcctggctgacggagtaatggctgagggctaccgactcaaaaccggagctttccatcagatacttccactgctctttgtcttcgaaccgttctcgtttggttcccgattgttcgggc

SEQ ID NO: 16266 - DNA, 544 bp, Malus x domestica
  Predicted polypeptide sequence is orthologous to G324
atgggacttgttcagacaactctgtggatgcagctgaatcattggaaggccatgaaaatgttttgtcttcttcatatgatgaaagcaagggtgcccgaggggactcacatgactctggaattgtaaaggagaaggaatcatacaatttctaccaggctgctgatggtcagcacatcattcttcatccattgaacatgaaatgcctgctacaccactatgggagccatgatatgctaccacacaggataagtggaaaaattttgcaattggagacagtgactcagacagaagctatgaggaggcgctaccgctacttgagtcatttttctttaacaacaatactccagttttgtgagattgatctgagtgaggtattgtctcctgatgccttgtctccctttatggaagacataaagaagcgtgaaaagcagaggaaacaacttgctaggaaggagcaaagggagaaaatgaaagctgaatctaccgtggcatatcccatccccatagtagcaggttatggacagtcctttcatgatggatcccc

SEQ ID NO: 16267 - DNA, 609 bp, Malus x domestica
  Predicted polypeptide sequence is orthologous to G326, G1337
tggtgagaatttggtgccaggtacgccggcaaggaatggttggcaggaggagaatgggagtgagaatatggaagggcatgcttcaattgatgtgaggaatgagaatggaggtgttgacggggttgtagctccagctgcggcttcgcagccagtgttgcagcagcaaacaccctttacgactctgctcatgatgccggaagagaaccgtgacggtgacatgttgtgggatagcaatccccatggacacaacactcagatatgggattttaatttaggacggttgagggatcatgaagagtcaggtccattggaagtcacatatggttcaaacgattcaggatttatgattaagaattttagcgaacttgtgaaagaaacatcattgactgatacaaaaatgttcagagatatgtaccaggtgaactgccctattggacatgaggacataaaattcaatttgaattttgacggccatcatcagggaccagcaacatctgcaagcagcaacgtccctattggacggccatcatcagggtcggtatttggcgaagacaaatgttgtggttcctctaccgacatcaattttatggaacaatcatttgttatgaa

SEQ ID NO: 16268 - DNA, 617 bp, Malus x domestica
  Predicted polypeptide sequence is orthologous to G328, G2436, G2443
atagtgttgtgccagttcatcagtatggagaagtagcgaaagcccaccagatgcagcagctgcagaagcaaagttttcatcagttgggtttggagtatgagtcctcaaaagctgcatacagttacaatggctctctaagtcacagtgtttctgtttcatccatggatgttggagttgtaccgaattcaacaatgagcgatatctcaatttcacacccgagaactcccacaggaactgttgaccttttcagtggatcttccattcaaatgccaacccaactaagtccaatggacagggaggccagggttctcaggtacagagagaagaaaaagacgaggaagtttgagaaaacaatccggtatgcctcaaggaaggcctacgccgagaccagaccccgaatcaagggccgatttgcaaagcgaactgaaatggaagttgaagtcgaccaaatgttctccacaacgctgatggcggaaaatggatatggcattgttccatcattctagttacgacattcaaaagatgaaagatgaccctatctcttcaaataacacttgtgctggtttttaatcatattactttaagtctgctactgatatttagtgtatctttttccc

SEQ ID NO: 16269 - DNA, 574 bp, Malus x domestica
  Predicted polypeptide sequence is orthologous to G347
cgcattttttttttttttttttgcagttcaaaaaaatatatatatactttatccggcagtcactcaacgaaaattggaacacacggtgacgtaatacattaatccgacgcctcgcatttgaaatgtctctcgcacagatgtttatgaacaactccaataaaaatatacaaccaatttgaacatgtctagcttccaagtaatctgtaatatggacttgatttgttccctgccatgtaaaactaggtgcaacagacttcagaatcctgctgtgctatttttttcccgttgtgacaccgacgacgacattgctcaccaatttgccactttcatcgacagacatagggttctcaacgacgacggtctggcttgctgaagtagagggcaccattcctgaattggttgtcccattaggtctgtgcgctggaattggaaccatcatattggacataccaacatttgtaacatactgacagagtgcacatttgactgaaggagctccttacggatacataagtggtgtccgacaatttccacagttgatgtggggcacctgactggatgctatttttgccat

SEQ ID NO: 16270 - DNA, 511 bp, Malus x domestica
  Predicted polypeptide sequence is orthologous to G347
gatggccaatatgagggttccaattccagcgcacagacctaatgggacggccaattcaggaatggtgccctctacttcagcagcaatgcctcattctcagagccagaccgttgtcgttgagaacccaatgtctgttgacgaaagtggcaaattggtgagcaacgtcgtcgttggtgtcacacggggaaaaactagcacagcgtgattctgaaatctattgcagctagttttacttcgcagggaacaaatcaaatccttattacagattacttggaagatagacacgatcgacattgggtgtatatttttattggagttgttcataaacatgtgtgcgagaaacatttcaaatgtgaggcgtcggataaatgtattatctaccgaatagacctgacgcggcgagcgagggttttgctgtcatttttgtgattgctatctcacccgtgccgtgtgtcccaagtttaatcgagtcactgcgcataaagggtatatgttttttgaactacaaatg

SEQ ID NO: 16271 - DNA, 692 bp, Malus x domestica
  misc_feature (120)..(120): n is a, c, g, or t
  Predicted polypeptide sequence is orthologous to G351, G545
atcctctctctgtctctctctctctctctctctctgtcaaaacaaaaaacagaatttctcaaattttcatcagcaagcatcagatggctctgcaagctctcaactcgccaacacacgccnggatcgtctcctttccagctcgagaccaaggcctcgagcttcagctatgtcgagccgtggaccaaacgcaagcgttccaagcgtccacgcctcgacacccctcataccgaggaggagtacctcgctctctgcctcatcatgctcgcccgcggtaatagagatggagacctcgccgctaccacagccactaaagcaacagcctccgctgcctcacaccagatcatcactcaatccccttctatggagctctccacgtcaacagcgccgccggctaacctgagctacaagtgctctgtttgcgacaagagcttctcttcttaccaggccctcggaggacacaaggccagccaccgaaaaggctctgctgccggatcggccgtcgaaggcccgtccacgtcctcaaccaccacaacctccgccaccaccaccgccatcccttcgggaaggtcccacgagtgctccatatgccacaagtctttccccaccggtcaagccttgggcggccacaagcgctgccactacgatggcggcgccgcaggatccaccgctaccacaagcgctataacttcctc

SEQ ID NO: 16272 - DNA, 519 bp, Malus x domestica
  misc_feature (460)..(460): n is a, c, g, or t
  Predicted polypeptide sequence is orthologous to G351, G545
ccgattttttttttttttttttgaatattccaattacttcaacagcatgtttatacaagaacaaaataatccaaacccgtaaaacaaatcaaagaaataactgaaattacacgccggatattaattccaatatttaattcctaatttaatgtctacagaagctgattcgcagagtcgaccggaatcgtcgtcctaattttgttggtcctgtgaagtctcggttttgggcttcatcatcagtagaagcctgggcttcttcgtcgggtgggggctctccacttcgtcctcgccggagatgaagaagtcgcgggagaactcgggcaacgccggcaggttcaggtcaaacgtctctcgggggtgaccgtggctgaccgcgtgagaagttgacccaactccctcagaggaagttatagcgctcgtggtagcggtggtggtggctgtggatccggcggcgccgccntcgtagtggcagcgcttgtggccgcccaaggcttgaccggtggggaaagacttgtggca

SEQ ID NO: 16273 - DNA, 600 bp, Malus x domestica
  Predicted polypeptide sequence is orthologous to G351, G545
caattctctcagctctctctcctcccattctctctctaaaaacagaaaacagaacctcttaaaagtttttatcaaccatcatcagatggctctgcaagctctcaactcgccaacagccgccggagcctctcctttcccatttgagaacgaggcctccagcctcggctatgccgagccgtggaccaaacgcaagcgttccaagcgtccacgcctcgacacccctcactccgaggaggagtatcttgccatctgcctcatcatgcttgcccgcggaaacagaggtggagacctcgcctctactaccgccaccgctgccacagccactaaagaaacaaactccgccgcctcacaccagatcatcactcaatccccttctatggagccctccacgtcagcatctccgccggttaagctgagctacaagtgctctgtttgtgacaagggcttctcttcctaccaggcgctcggaggacacaaggccagccaccggaaaggctctgcagccggatcggccatcgaaggcccgtccacgtcatcaaccacaacaacctctgccgcggccaccgccaccgcttccggtaggtcccacgaatgctccat

SEQ ID NO: 16274 - DNA, 691 bp, Malus x domestica
  Predicted polypeptide sequence is orthologous to G363
cacgaggcatgagccaagtaacttcgaacatacctctgcaagaagaatcccctgacgcctctaaggacagcacaaccacttcttcatgcctcacaaatcagacaaaccatcaacaacaagatcccgggcctgttgcacttgacttgacactccagttttgctccagcgacattgaattgaagggcacaggggagactagcagtgaaggagctgcaccccctacttcagaaggaacaaacccaagggtattctcatgcaactactgtaagcgtaagttctatagctcacaggcactcggtggccatcagaatgctcacaagagggagaggacaatggccaagcgtgctatgcgtatgggaatgtttcccgacaggtatactagcttggcatctctccccctacatggttcagccgcttctgcattccggtctcttggtatccaagctcattctgcagtgcaccaaaacacaatggtatcatcagatcatccgaggttccctgtccccgacacaagaggcgtagcgaggtttcaacagggctattttggagtgccggtgttcatggacgaggatgacgagggcatgttttggcccgggagtttccggcaggtaggcaaggagggagttggaggtcattacaatgtgcaatctgcccaaaatccaaatatgaattcagggacaagctcggcacc

SEQ ID NO: 16275 - DNA, 647 bp, Malus x domestica
  Predicted polypeptide sequence is orthologous to G363
cacgaggatttttaagtgaactgtttgttctcagtctttcatgatctcacccaccactttgttttatcagaaagcctgttctttgttttgagatgttcaactgcaattctatgacaagaaacactcaactggcagatgtctgctaattcaagcattgcaatactatggaatccaggagctagccaattgtacttggtcttcaaccagatctatggatgtataagatcagctagcccttactggaccagctcaatccggttatttcaagtctgatatgtaaactatcccccccacctcaacgacagccaatcatgaacacatatattgaccttgaagtggaagcctcatcggcaaatgactctgatgttagcagccaagttgcttctaacatctccatccaagatacatctgctaatacctccaaagacagcgcggctaactctttccatttttcatacctcaatgcagctcagcaaggattgggtcctgcagtttcccttgatttgacacatagcttcaataaggaggacttagggagaagggattcgacaggactctcattgtcgagcacgagtgagagcagcaatgaaccttcatctcagaacatagcatcagccagtccaagacttttttcttgcaattactgt

SEQ ID NO: 16276 - DNA, 262 bp, Malus x domestica
  Predicted polypeptide sequence is orthologous to G375
ttttttttttttgaaagataaagccaatcccggctaatcagttctcatatcaaatcgggatcacaaaatcggcaaccggtggaaatacaaaacagtaacatatttgccatgtcaaggaagccaagttcttattcggttttacgtgaatcacacttgtcagaaccctataaatgtgaataggaaatgatgatctagtgatctccaaaactacgaaaagatcatctaatgataccacacgagagggattgtgtgccgcgattgg

SEQ ID NO: 16277 - DNA, 553 bp, Malus x domestica
  Predicted polypeptide sequence is orthologous to G377
acaaacccttcaattcctctccacttatacaataccatggcattttgtgttggtattaaggtgtctaaatggtttacgacactgctcgtcctcgtccactgctttatgatcttgttgatagttgcactttcctatgtaggtctgcttaaaccttcccaagagatgaccgagttagaagactatcgtcgtcgacaaactgacaatcattttgttttgctggatcgtctgtgcccgtcggcagtccccgtgccgatccatgttctaacagaatacatcaagaggaagcttccggtagtggagtttggtcaagttttcgacaaatacacaaggcttgaaagtcgggacacagaatgcaatatatgcttggagtgcatagaaaggagccatgaggtgagggaaccttgcaactgtgatcatgtgtttcacagggagtgtctggatagttgggtcaatcagggccaggtaacctgccctttgtgcagatctctgttgtttccggccaagagcgaaataacgagctgcggcgaaggaattcagggacgacggagaggga

SEQ ID NO: 16278 - DNA, 566 bp, Malus x domestica
  Predicted polypeptide sequence is orthologous to G380
ccacgcgtccgtggctctggaagagcgtatcggaaacgtgaacactggattaagtgaagaaaccatatcaaagcgcttgaaacataagaagtatattgcagtaggatcttcggcagatacagagccatgctgtgtatgccaggaggaatacaatggtggagaagatcttggaacgctcgaatgcggacatgatttccacagcgagtgcataaaacaatggctgatgcacaagaatttgtgccccatctgtaaaactacagccctggcaacatgaggtcgacgacgtcaaatgtttttgcaggctagtttttcttcaaattaggtaaggagggttgcttatggaatcagtctgcctacatatgggctcactgagtcccaatgcctcgatgctttcacctttccgtgttggtcgagttgaagttggtccaaagcactacttcaagcgcccgagcggaaaattaccttaattattttttattttatttaaaaccaggcctcttattggaggcatcacatttcgaagttggaaaagcaaaactgatactgacttttcattttatcaatga

SEQ ID NO: 16279 - DNA, 576 bp, Malus x domestica
  Predicted polypeptide sequence is orthologous to G383, G1917
ttttttttttcaattctaagcaaaaccagtttcagaaaacccatttaaaaaatccaacttttactcgaatcccattgaaaaaaggaagaaaaatagaatagaaaaaaaaaaaaaaaccatgcataggtgcagtagtggctcttcacatggcggcaacatggtcggcggtccatgttcgtgcggtgtccttcaccatacccaatccaactcctccttctccatgctcttctccatgcctaatcaccacaagccgtacaatcatattcatcacgaaacatcgtacgatcatcatcacatgtacccgttcgcatccccatcgtcctccgtcgattgcactctctccctaggaactccctcgacccgtttgaccgaaaacgacgccgtttccgacgacaggcgtgcgcgcaacggcgagcggcgctccggtaactgcgtttccaacttctgctgggacttgttgcagcccaataagtcatctccgtcttcccatcacaaaacccccagccgcggtggcaatttcaacggcgttactaacgctgttagtggtaataacgatcccccttctcgctcgacgct

SEQ ID NO: 16280 - DNA, 2423 bp, Malus x domestica
  Predicted polypeptide sequence is orthologous to G384, G385
ccaaataaaaacccaactggaaccccatgaaaactctttgctgaggcaagagaacaataagctccgagcggagaacatgtcgattcgtgaggctatgaggaacccaatttgctcaaactgtggcggtccggcaattattggagatatatcactagaagagcagcacctcaggatcgaaaatgctcgattgaaggatgatttggaccgagtttgtgcactcgccggaaagtttctaggccgacccatctcatccctgggtgcatccatggggcctccgctcccgagctccactttggagctcggagttgggagcaatgggtttggtgggatgagcaatgtggctacatcgatgtccatgggaaatgattttggaggtgggattgggagtgctatgtcagttgtgtctcatggcaggcctagtgtgacggggctagaccggtcgatggaaagatcaatctttctagagcttgctttggctgccatggatgaattggttaagatggctcagacggatgagcccctttggcttaggagcttagaaggtggaagggaggttttgaaccatgaggaatacatgagaaatttcactccttgcattggattgaaaccgaatggtttcgtctccgaggcttctagggagtctggaacggtcatcatcaacagcttaactcttgttgaaactttgatggattcgaatcgatggttggagatgtttcctggtgtgcttgcaagaacctcaaccactgatgtgatttccagtggcatgggaggaactagaaatggtgcacttcaactgatgcacgctgaactgcaagtcctatcgcctttggttccggttcgtgaggtcaatttcctccgtttctgcaagcaacacgcagagggcgtgtgggctgtggttgacgtgtcagttgacgccatccgtgacaccaccggggtaccgacatttatgaactgtaggacgcttccttctggctgtgttgtgcaagacatgcccaatgggtactctaaggttacttgggttgagcatgcagagtacgatgagagccaagtccaccacctataccgacccttgttaagttccggcatgggcttcggcgcccaacggtgggtctccacccttcaacgccaatccgagtgccaggccattctcatgtcctcctgcgtcacctcccgcgaccacactgccatcactgccagcggaaggaggagcatgctgaagctggcgcagcggatgacggacaacttctgtgccggggtatgcgcatcgacggtgcacaaatggaccaagctgaacgccgggaatgtcgacgaggacgtcagggtcatgactcgggagagcctataccaccctggagagccgcccggtgtcgtgctcagcgctgccacttcggtctggctgccattctccccacagaggctatttgatttcttgcgcgatgagcgactaaggagcgagtgggacatactctccaacggtgggcctatgcaggagatggcccacatcgccaagggccaggaccccggcaactgcgtctccctcctgcgcgccagagcaaacgcaaaccaaggtagcatgctgatcctacaggagacatgcatagacgcggcagggtcgcttgttgtgtacgcgcctgttgacattccggccatgcacgtggttatgaacggcggggactccgcctatgtggcgctcctgccatccgggttcgcaatcgtacctgatggcccaggctcgcgcgggcccatgtttggcaaaggcggcagtcacggcagcggcaacagtggcggtggcgttgacgacggtggccatagagtgagcgggtccctcctgacgatgacgtttcagatcctggtgaacagcctgccgacagcgaagctgaccgtggagtcggtggagacggtgaaccacctcatatcgtgtaccgtccagaagatcaaggccgccctccattgtgagagctgatcatccatccgatcatatatcctgtgtggggtcacgtgatctaacctcaccttgtagcttttgtgtttttgttaggagacttttattaatgtggttgtgcatgtggcggcggtggcggtgtaagttatattaggcggcggtgcatgatgagtgaatctggtgggggtattgagtcaagaacgaaccgcactggagagtccttgcatggtgataaggatacatgaaacttgcacgcacgtgtgatgacttgcacacgtgtttggggagtgcgttcttagcacaatgcaaggctggtggttcgggtattgactcgggtccacccctgttttaaatccagaaaatgagtctggctcaacatggattgtgaaaagcaaaaaattgttggggaaattgaacctttttggagttttatattttagttaaaagttttgtgaatttaaaaaaaaaaaaaaaaaaaaaa

SEQ ID NO: 16281 - DNA, 551 bp, Malus x domestica
  Predicted polypeptide sequence is orthologous to G390, G391, G438
cacaattgagcatgaagagttcatggaggtcattaagattgaaaacatgggccactatcgagaggatatgatgatgcctgcagctgacattttcctcttgcaactgtgcagcggagtggatgagaatgccgtcgggacctgcgctgaactagtatttgctcccattgatgcatcattttcggatgatgctccaattctaccttctggttttcgcatcatccctcttgattctcggatggatactccgagtccaaaccgtacgcttgatcttgcctcagctcttgaagttggacctgcaggaagcagagcatctggtgataatgctggccactctggcaatacaaagtctgtgatgacaatagcattccagtttgcatttgaaattcacctccaagaaaatatagccgccatggctcggcagtatgtgcgcagtatcatagcatcagtgcagagggtggcactggcactctccccgtctcattttggttcgcatgctggtttccggcctccccctggcacccctgaaacacaaacacttgctggttggatct

SEQ ID NO: 16282 - DNA, 412 bp, Malus x domestica
  Predicted polypeptide sequence is orthologous to G390, G391, G438
ccgattttttttttttttttttaaagggagaagaaaacaaagggcagcagcattatgattcataaataaagcataaagaaaagtagcaaagagtagatgatattgataaccaaaaaaatttgggcccaatatgcctttggtgcaaagaagaggttttaatttctaagttctatatcctatgatgttgttcttgtggcctccaaagtgttaaacaaatgaccagttgatgaacatgaagcagatgcagtgagcagtttcttcttcgttcaacaccttccatgccactgctctctcgtacgagatcggccttcccatgcttgacatgcatattcctccttgaagacacataaaaccctgctgcattatctgcgggaactcggagcatagggtcttccttccgtcccaacacaat

SEQ ID NO: 16283 - DNA, 615 bp, Malus x domestica
  Predicted polypeptide sequence is orthologous to G390, G391, G438
aatgcgggttgtgtaagatctgtgatgactatagcatttgaatttgcttgtgagagccacatgcaagagcatgtagcatccatggcccggcaatatgttcgcagcattatatcgtcagttcagagggtggcattagctctctctccttcacatttgagttcacaggctggtcttcggtcaccacttggtactcctgaagcgcaaacacttgctcgttggatctgtaacagttacaggtgctatttgggtgtggagctgctcaaatctggcaatgaaagaagtgaatccatcctcaaatccttgtggcatcactcggatgcaattatgtgctgctctctgaaggcattgccagttttcacctttgcaaaccaggcagggctcgacatgctggagaccaccttggttgcgctccaagacataactttggaaaagatatttgatgaccatggacgaaagactctatgctcggaattcccccaaataatgcaacagggtttcacatgtcttccaggtggcatctgtctttcgagcatggggcgaccggtgtcatatgaaagaacggtggcttggaaggtgttgaaccaacaggaaaccgctcactgcctgtgtttcatg

SEQ ID NO: 16284 - DNA, 624 bp, Malus x domestica
  Predicted polypeptide sequence is orthologous to G394
cctcctcctcctcctcctcctccttcttctgccaaatgggtttcgatgatcatgcttgcaacacaggccttgtattagggttaggtctgacgtcgtctgctcctcaggagagttgtaaccttacaaagtttgcaaagaataatattaagccttccctaaattctgctccaacaagtggtgcttttgagccatctttaactttaggtctttctggtgagccatatcatcaacaaacagtagcctccaatatttacaaggttggtaattcttctcaggatgaagcaattgatttgtacaggcaagctgccgcagcgtcctctcctcacagtcatagcgcagtctctaactccttctctagtggtagagtggtcaagagggagagagacctcagcagtgaagaggttgatgtcgatgagaaagtctcctcaagagtgagtgatgaagatgaagacggttctaatgctagaaagaagctcaggctcaccaaggaacaatctgctctcttagaggaaagcttcaaacaacatagcactctcaatcctaagcaaaagcaagctttagccaggcagttaaacttgaggccaagacaagtggaagtatggttccaaaataggagagccagga

SEQ ID NO: 16285 - DNA, 650 bp, Malus x domestica
  Predicted polypeptide sequence is orthologous to G394
ggattgggtgttgaagaaatagagggagaggtagaagaagatagagtagtgaatatcactacttcatcaagagtaagcgacgaattatatgatcaagatcaagatcacgagggcagtcctagaaagaaactcagacttacaaaagaacaatctgccactttagaggacagcttcagagagcacactactctcaatccaaaacaaaaacaagaactggcaagaaagctaaacttacgcccacgacaagttgaagtctggttccaaaacaggagggctaggaccaagttgaagcaaacagaagcgagtgcgagttgttgaaacaatgttgtgaaacattgaaagatgagaacagaaggctacacaaggagttgcaagagctcaaattaatgaaacatacagcaacagcagcagcacccctttacatgaagtttccaactgccactctcaccatgtgtccctcctgtgagaaaatctgcaacggcggcgatcattataatcataatcacgagtcatcgacaagtccatttttagtcgggtcgaataagactcacttgatcttcaacccctacagcactcatccatctacagcttgctagctatagtctgctgccaaattaattaaggccagattatcactagctagccttttt

SEQ ID NO: 16286 - DNA, 643 bp, Malus x domestica
  Predicted polypeptide sequence is orthologous to G409
cacaagttcccagccatagaaaaagcaaaaccttgcagttgcagaacgctttcttcctctgcaagaaaaaacctcatgatttcaccatttttctcactcatcccaagctcttagtaactttcacagcttctcgtgagtgatgggcgtgatctcctctttctctcatactttccacattacagtgattctgacattaaacccaccacttttaagcccctgataatccgattaattacccacacagcatttaaattttgtgaactgattacgtttaacatatatgacgagtgggaaactctacggttcttctgcggacatgaaagtaatttttcaaaacgaaaagcgacctcgctcttctgacgttctcgagtctctctggattcccactccttcctcttcttttcatggttcaaattcaatggttaattttgaaaatgtaagtgaaggggactccttggataggcctttcttccaacccaaacaagaaaacgaggatgaggattattacggtggctaccttcatcaacccggaaagaaaaggcggctcacggcgaatcaagttcagtttctggagaagaaattcgagttagaaaacaagcttgaacctgagaggaaggtgcaacttgctaacgaacttggcttg

SEQ ID NO: 16287 - DNA, 710 bp, Malus x domestica
  Predicted polypeptide sequence is orthologous to G409
atcagatggtacatatgctggagaagagctttgagacagagaacaagctggagccggagcgaaagacgcagctggccaagaagctaggcctgcagccgagacaggtggccgtctggttccagaaccgccgcgctcggtggaagaccaagcagctcgagcgggactacgaccttctcaaatcttcttatgacacccttttgtctaattacgactccatcctcaaggagaatcagaaactcaaatcccaggtggtttccataaacgagaagcttggaggtaaagaggaggctaatagcacaaaagcagcaacatttgcaggggctgaccacgatgacgagaagcgtggccctcttcttccagcgggcgatcagatgacggaggttgttccaataactagtctccagcacagttgcaccatcaaggcggaggaccgcctgagctcagggagcggaggaagtgccgtggtggacgaggccgaaggcgctcagcctgtggacagcggtgactcctataatttcccaaacaacatccataacgactaccctcatgatcatgatacccatcatcatcatcatcaatatgtggcgccacatgatcatgtagaacatcatcacagcggagtccactcagaagaagatgatggtagcgatgacggccagggttacttctccgatgtctttgcagtcgcagcggcggagcagcaagcagca

SEQ ID NO: 16288 - DNA, 566 bp, Malus x domestica
  Predicted polypeptide sequence is orthologous to G409
tgaggagttgcaagccaactacaataatctcaaggctaattgtgaaagcctttccaaagagaacgataaactaaaggccgaggttactgtcctctcagacaagctgcatctcaaagagaaagagaggggaaattcagaactatctgataccaacagattatctcaagaaccgccgcagaagccaattgctgacacggtctctgaaggcgaagtatctaaagtctcagctgtggcctctaagcaggaagatcttagttcaggcaggagtgatatatttgattcagacagctcacactacacggatggagttcactcttcactcttggagcctggtgattcttcgtatgctttcgaacctgaacaatctgacctttcccaagatgaagaagataactttaccaaaagcatgctgcctccatacatcttcccaaagattgaagatgttgattactccgatacacctgcgaattcatgtaattacgcattcccggtggaagatcatgccttttggtcctggtcttactaagtttctaatggcaaatccgaatccccggggtattatcatc

SEQ ID NO: 16289 - DNA, 691 bp, Malus x domestica
  Predicted polypeptide sequence is orthologous to G409
ttgtagcagcagaacaaaaacaactctttcttcttctgcaaaacaaccccatgattttaccattttcctctctcaccccaagctctttactctcacaagagtgatggatgtgagctccactttctctcacactttccacattgcagtaatcctcacattaaacccaccacccttaagcccctgataattcgattaattacacacacatcatttgatttttgtaaactgattgcattaatatatggcgagtgggaaactctacggttcttcttcttcttcttctgcggacatgaaagtaacttttcgaaacgaaaagcgtcctcgctcttctgacgttctcgagtctctctggattcccaatccttcctcttcttttcatgcctcaaattcaatggttaattttggaaatgtaagtggaggggattcattggataggccattcttccaacctaaagaagaaaatgaggatgaggattatgacggtagctaccttcatcagcccggaaagaaaaggcggctcacggcgaatcaagttcagtttctggagaagaattttgagtcagaaaacaagcttgaaccggagaggaaggtgcaacttgctaaagaacttggcttgcagcctcgccaggtagcaatctggtttcaaaaccggcgggcgcggtatagaacaacagttggaaaaggatatgat

SEQ ID NO: 16290 - DNA, 723 bp, Malus x domestica
  Predicted polypeptide sequence is orthologous to G409
tgtgtgcagccgctgttcccacacttcccacatcacagaaatcatcatcaccagcttcttccgccacaaagcgtgattctttccaacccagagcttcggatcactctacttctcaaacaccaagctgtgatgttctcgacagcaacttaacaaacgcctagtatacaaaactaattcgtcggagtgttgactgtgaacatggccggcgggagggtcaacggcggccgaaattcgtccgtcctcagtgctttgcttcagaaccagaggagttctgagcctcttgattctctgttcctttctgggtcatcaaattcttcctctgcttcttttctgggttcaagatcgatggtgagtttcgaagatgtacgcggaggaagtggattgaataggtcattgttccaccagtatgagcacgaagataacggggaagatgacttgggtgagtatctccatcaacctgggaagaagaggcggctaaccgctgatcaagtccagtttctcgaaaaaagctttgatgtggaaaacaagctggaaccagagaggaaagtcctgcttgcaaaggaccttggcttgcagcctcggcaggttgcgatatggttccagaaccgccgggcgaggtggaagacaaaacaccttgagaaggattatgaggtgctgcaagccaactacaataatctcaaagctaaatgtgaaagcctttcaaaaaaaaatgataaaactgaa

SEQ ID NO: 16291 - DNA, 3097 bp, Malus x domestica
  Predicted polypeptide sequence is orthologous to G418, G965
agatatattaattagtgaggagtctccgaaagaaagccaccattttcaattttatattagcaaacatatactccctctcttgctatcgcctcttttttttcagaagggttgaaggtgattgcataaacactcactgcaaagagaaaaaaaggagaaagaaaaggagagaaggagaaagacagagacgacagacagagcgacagcacaaacaagagagagagagagagagagagagagagagagagaggaattccagaagctttcaataccacagaagggaaaacgatgtctgagagctttacatcctttcatactctgcaactcctcgagtaaatcaagcgtgaaaagagagggaagcgactacaaagccaacaaggggagggagagagagataaaaatgatgaggaagaagatcagtactagttttatgatatgggcatagtaactttaccgccactcccaccaccgccaccaaagggtaatcttcatcatcgtcaccactcaattgattcagaaaactactccaatcctcctaattctatgtcccaagactaccaccaaggcatcttcactttctccaatggcttcgagagatcggctatgacaactcaccaagaacaacagcagcagcagcaacaccacttggcacagcagatccggagggaaaagctgagggtgcaaggcttcgaaacccctcccccgccgccactggttggcctaaacgaggaagaatccagtggcctcccagcatacgaaaccgctgggatgttgtctgagatgttcaattaccctccaggcggtggccctgttggggccgccgaactgctagaacatccaatgtcagccaattatcggatgatgcctcggccgcagcaggctgcagcagtgtctgctgcggctgactggtacggaagagtgggtggtggtggattgggaccattgggagattcaaaaaatcagcaccatcatcagatttcaacaattaatgcagactcagcggcagccatgcagctttttctaatgaacccatcacaaccaagatcgccttctcctcctccttctcacaccacttcttccacccttcacatgttgcttccaaacccttccaccaccaccaattcactccaagggtttgctgccgcatccggtggaggggcttttggtcaattcacttgggtccctgagagtcatcaaggccatgaagcaggaggcaataccgctggcggcggtggtgaaattggtggggttgtggaaggccaaggactttcattgtctctatcaacttctttgcagcacttggaggcagcaaaggctgaggaattcaggatgggatcagatagtgctagtggcttgctgtattacaataatcaaggagatcatcaacatcaagggtctaatcctcagtataagaatttgggttcccatcatcatcaggcattgcatagtttgcagcaaggcggcgttgtaggcggtcatcacgtcagtttcgggtcgtcatcgtccttcggggttgtgaacgtgttgaggaactccaagtatgtgaaggctgcccaagaattgttggaagagttttgcagtgtggggaggggtcagctcaagaagaacaagtttggtggtagtacaagtggtaggcagaacaccaccacaaaccctagttctaatccagctagtggcggtggcggtgatggtggtgcctcttcatcttcatcaaaggatgtgcctccgttgtcagccgctgataggattgaacatcaacgaaggaaagtcaaactattgtccatgattgatgaggtggatcgaaggtacaatcactactgcgaacaaatgcagatggtggtaaacgcattcgatctggtgatgggtttcggagcagcggtgccgtacacagctctagcacaaaaggccatgtcacggcattttcggtgcctaaaggacgcgatcgcggcacagttgaagcacagctgtgagctaattggagagaaagatggtgcggggacctcaggaataacaaaaggagagaccccgaggctgaagctgctagagcaaagcctaaggcagcaaagagcatttcatcaaatgggcatgatggaacaagaagcttggaggccacaacgaggcctgccggaacgctcagtcaacatcttgagagcctggctttttgagcattttcttcacccgtatccaagcgatgctgataagcatctgttggctcgacagactggtctgtccagaaatcaggtctcaaattggttcataaatgctagggttcggttgtggaaacccatggtggaagagatgtaccagcaagaagccaatgaagaagaagaagtaggagaaggaggagtaggaggagctactagtgcagcagcagatcaagagagagaacgtaacagcaatgctggcctcgctgcacaaactccaacgcctacaacgacaacaacaacaacaacaaaaaattcgccagcaagcaaaagatccgatatcaatgcctctgaaaacgacccttcactcgtagcaatcaataggcatcagcagcagcagcaccaccaccctatgatggccaccaccacctctactacggtggcttctcctgcgtaccagtgcttccccgccgcagcttccgatgacacgtgtcgaagttacgggaccacctcggctaatgcaaatattgcagctcatcatgatcatcaaaatagtagtaatatcgattcttctactacgcttataagcttcgggaccaccacggcagctggtgacgtgtcactcactctagggcttcgtcacgctggtggtggtggtggaaacaatatgcccgacaagacttcttcttctttctccattagagacttcgggggctgttagggaattaatcaaccacttctctttattgattagtatatcaaacttctatagactatagaacgtagtaaaaagaaaagaaaaaaacagttaatgagtttctttatcttttttcaatatttttttttacttaaatatatatatatatataaccttccatccattctatgaagaaagaaacatggtgagaaaagtagcattaagtaaaaaaaaaaaaaaaaaaaaaaaaaaaaaaaaa

SEQ ID NO: 16292 - DNA, 1886 bp, Malus x domestica
  Predicted polypeptide sequence is orthologous to G427
gctctctctctctctctctctttctctgaagctctcatctttctctctctacatttctgaaaacacagagactatatagtctacagagaacagatatatatatatatatagatatacaaatccagccatatatcgttgtcttgttgtctctcctcacagagcttccaattcttcatccatgtcctctgaattttcttctcctcttctcttctccttttttaattcatttttcagtcagtaaagggaaaaaacagagcgcctctgtttctgcctccgtctgtaaattggtgtacccagctgcacccagctgatcatccgtattcatggcgtaccacaaccacctctcccaggacctccctctccaccacttcaccgaccaaacccaccaccagcaccagcaatatcaatcggaccaacccgacccgaactccaagcccccagagccccaccactcatttcagcccgcccccaattggctcaactccgccctcctccgcaacttcaccaacaccgacaccaacccaaccaacagtaacaacgcaaacaacaacggtggcggcgtctccaatttcctcaacctccacgtcaccgcctccgactccgccgcctcccaagcatccaaccaatggctctcccagtcccaccgcccgatcctccaccgcaaccacagcgacgttaatgatgacgtcaccgttgccggcgactccatgatcgccgcggcgttgtcccacgactccgccgacctcaagcccgacagcatcctcaacaagaacgaaggcggaggaggagacggcggggtcatgaattggcagaacgcgagacacaaagccgaaattttggcgcacccgctgtacgagccgctgctgtcggcgcacgtggcgtgcctgcggatcgcgacgccggtggaccagctgccgaggatcgacgcccagctggctcagtcgcagaatgtggtggcgaagtactccgccttggggaacggcatggtcggcgatgacaaggagcttgatcagttcatgaggaattatgttttgttgctttgttctttcaaagaacaactgcaacaacacgtccgggtgcatgcaatggaagcagtaatggcttgctgggagattgaacaatcacttcaaagcttaacaggagtttcccccggtgaaggaacgagtgctacaatgtcggatgacgaagatgaccaagtagatagtgatgcaaacttgtttgatgaaggtatggagggtcatgacagcatgggattcggcccccttatcccgacagagagcgaaaggtccttgatggagcgcgtgaggcaggagttgaagcatgaactgaaacagggttacaaggagaaaatcgtagacataagagaggagattttgcgcaagagaagagccggaaaacttcctggtgacaccacctctgtcctaaaagcttggtggcaatcacattccaaatggccatatccaactgaggaagacaaggctaggttggtacaggaaaccggtttgcaattgaagcagataaacaattggttcatcaatcagcggaagaggaactggcacagcaatccttctacctccacggttttgaagagcaagcgcaaaaggtgaaaacagcagtggcgagcggttcatataaattggaataggaaatgagagccagtcgagatgtcgtttgtgcgcttccactacatttacaattcgaagatagaaactctgaatagcgagaagacttcagggttccggtgaaaacaatcatattggtttcttcagaaagaaaaaggctcactctgattctgaggttgcgattataaacccgatatgagccgttacacaggtatgctcaaaggatgcagatggtcgaagcgtatggaatatcatatatcatta

SEQ ID NO: 16293 - DNA, 716 bp, Malus x domestica
  Predicted polypeptide sequence is orthologous to G427
gcgaagtttcgggtgcaacaatgtccgatgatgaggatgacatgccgatggatttcacaatggatcaatccagcggcgaagggcatgatatgatgggatttggccccttactcccaactgaatctgaacgatcgttaatggaaagagttcgacaggaattgaagattgagctgaagcagggatttaagtcaagaattgaagatgtaagagaggaaattctaagaaaaagaagggcagggaaattacctggggacacaactacagtgttgaagaattggtggcagcaacactctaagtggccctacccaactgaagatgacaaggcaaagcttgtggaggagacagggttgcagctgaagcagataaacaactggttcattaaccaaaggaagcggaactggcacagcaactctcaatcggtcacctccttaaagtccaagcgcaaaagatagacaaaaacaccataaccaccgttggatcttgtttgataatcggagaaactgatgaactcatgacttttgtgtctgctgaattgtgtgacattggggaagtatatatagtctaattagccaacgctctgaaaacagggaaattgaagtaacaaatggccaactaattacatgtgagaggttgtataaattcatgttttccaaatttcgatcggtagaataatggtacttcatctttatatactatatttccatttacttttgtct

SEQ ID NO: 16294 - DNA, 621 bp, Malus x domestica
  Predicted polypeptide sequence is orthologous to G427
agtataataggtgaagaagtggaggaagaactggaacagggttacaaggaaaagatcgtcgacattagagaggaaattctgcgcaagagaagagcggggaaactgccaggtgacacaacttctgtcttaaaatcttggtggcaatcgcattccaagtggccttacccgacagaggaagacaaggccagattggtgcaggaaacaggcttgcagttgaaacagatcaataactggtttattaatcaaagaaaaaggaattggcacagcaacatttcatcgacttccgttctcaagagcaaacgcaagagtaatgcaggtgacatgaacaaccaacgattgaagtaaatgtcatgattttagtcgaaaatctagcaacagagagcaaggaatttaatatttctcgtacagtaaaagcttcaagccttcaaatggtatgctgcccatctttggatcgatcgcttcgagtctgaggcaccccgacactatccatgtcttatagtaccataatatcatcaaactctaagcatgtaacacgaaaaactcgaaccaggtagccttaatgtactacgtttcagtggatctatgtagattttttgtataaaaaaaaaaaaaaaaatgctg

SEQ ID NO: 16295 - DNA, 580 bp, Malus x domestica
  misc_feature (506)..(506): n is a, c, g, or t
  Predicted polypeptide sequence is orthologous to G428, G1594
aggcacaagactctccgcggacaaaggaagatcatgagctcaaggataaactgttgcgtaaatacagtggctatattagcacccttaaacatgagttttccaagacgaagaagaaaggaaagctaccaaaagaagcaaggcaaattctctttgattggtggaaccttcactataaatggccttacccaacggaagctgattaattatctggtatggtgcaggaagctgataaaattagtcttgcccaagtgactggactggatcagaaacaaattaataactggtttataaatcaaaggaagcgccattggaagccatcagagaacatgcagtttgctgttatggacaggctttatggaccatgttttaccaaggattgatccggcaatttaccatcctgtttttactctttgtacatgattaataattaactcaatttggttatgttcctcgtttactaatgttcgttttgttattagtatgtgtaaggacaaaatattatgtangatagttgcaagatgtggatagacagctatattatgatgattgactggggacttaaaaaaaaaaaaaaaaatgc

SEQ ID NO: 16296 - DNA, 532 bp, Malus x domestica
  Predicted polypeptide sequence is orthologous to G431
aatattccatggatcctcaagctgaagatagagaactcaaagttcaacttttgcgcaaatacagtggatatatgggcactctcaagcaggaatttatgaagaagaaaaagaatggaaagttgccagaggaagcccggcatcagttgctggattggtggtgcagacattataagtggccttatccatcggaggctcagaagctagcattggcagaatctacaggtctggatcttaaacagataaataactggttcatcaatcaaaggaaacgccattggaagccttcggaggacatgcagtttgttttgatggatccaactcttcatcaccatcatcatccccacatctatatggacaatgcaatctgcaatcccttctccatggattgttcatctactcggctgtaatcatcacttttgcattctaattattagtatcgatcatagggcttctgtattatgtattatgaatgcattatgactttgtcactttggtcccgcttattcgtcacttttctaccaaaaaaaaaaaa

SEQ ID NO: 16297 - DNA, 638 bp, Malus x domestica
  Predicted polypeptide sequence is orthologous to G431
aagatcatggctcatcctcactatcaccgcctcttggcctcctatatcaactgtcaaaaggttggtgcgccgcctgaagtggtggcgagactggaagaagcgtgcgcatcggcggcgactgtaggtcaaatggtgagtagtagtagtgaatcaggatctctcggtgaagatccagctctggatcagttcatggaggcctattgcgagatgcttaccaagtatgagcaagaaatctctaaacccttcaaggaagccatgatcttcctccaaagaatcgagtcccaattcaaagcgctcactctttcttgttcttctgattctgcaggttatggcgatggaattgataggaaccatgtatcatctgaggaagaggttgatgttaataacaacttcatagatccccaagcggaagacagggagcttaaagggcagctattgcgcaagtacagtggatatttgggtagtttgaagcaggagttcatgaagaaacggaagaaagggaagctgcctaaagaagccaggcaacagttgctagattggtggagtcgacattacaaatggccttatccatcggaatcacagaaactagctcttgcagaatcaacagggctggaccagaagcagataaacaactggtt

SEQ ID NO: 16298 - DNA, 480 bp, Malus x domestica
  Predicted polypeptide sequence is orthologous to G431
agttcagaggaggaacttagctgtggggaggtggaagcagcagagggtcaagacactggtggtgctcgttctagtggtgatcgggaactgaaagatatgctgctgaataagtacagtggctaccttagcagtttgaggaaggagttcttaaagaaaagaaagaaagggaaactaccaaaggatgccaggagtaccctatcggactggtggattactcactataggtggccatatcctacggaagaggagaaactccagctgtctgagatgactggattggaccaaaagcagattaacaactggttcataaaccagaggaagaggcattggaaaccatctgaggacatgaggtttgctctcaaggaaggcgtcggcgggagcatcggaagacctatgatgtttgacactggtgttggaactggaaatattcacgatgatatgtgatatcattgtatcaagtatttggttgattctaatatt

SEQ ID NO: 16299 - DNA, 389 bp, Malus x domestica
  Predicted polypeptide sequence is orthologous to G440
tggcaagtatctcatggagcaatcagttgcaaagaagcgccatggttaagcatcctcgcacaacatcgagaacaagtaaactagttcatgttttctacaggacctggagttaaattcgacgtatgttctactataatcataaacaaaaatagtttgcgtagaagtgtattctacgtacaacatggatctttaatcgttaattgtatcatcattttgacaaaaaaccgtattaactggacatttggaaattgaggcttgtcttccattccgttgcttaaccgctgcgatgctctggttcaagcataaagagtgtcaagcaattccaaaatgtacatggtattgtcgtagtgaaagcactaatatttaccctcggatgaggaaaaaaaaaa

SEQ ID NO: 16300 - DNA, 653 bp, Malus x domestica
  Predicted polypeptide sequence is orthologous to G446
cacgatagttggtattagtgatttagatccgctgagatggcctggttcaaaatggcgaaatcttcaggtagagtgggatgagccagggtgttgtgataaacagaacagggttagttcatgggaaatcgaaactccggaaagtcttttcatatttccttctctgacttcgagtcttaaaagactgatgcactctggattcttgggagcagaaaccgaatggggaaatatgaccaaaagatcattcatccgggttcctgagattggaaacgggaactcttttccatacccgatttcaaatctatgttcggaacagctagtcaatatgctaatgaaacctcagcttgttaatcatgctggaacattagctactctacaacaggaatcggctgctaatgtagattcagtagatatgaaggccatgcaggccaaaatcaaccagaagaatccagctgatggcgtaaacgcgaatgcaccatctcatggaattccaccgggaaatctgaacaccgtagccaagtttggaagccaagcaccagttggaagtagcactgagaagatgaaatcagaacctgaactttctgcagatcagttaagtcagttgagttcggcagggcaaggcatcgaggataaattagctgcagggtttgcgagtc

SEQ ID NO: 16301 - DNA, 725 bp, Malus x domestica
  Predicted polypeptide sequence is orthologous to G447
ggcccaagaaggttatctggaaacttgctctctcatggacttaatgttggagcacagtggcagcagcagcagctactgcaacggtctccttcgctgccatccccatctcaacaacattaccagcaacaagaacaacagcagcagcagcaggaacaagagtcaccccaacatcaactgcctctgcaacagcagtctcagcagcaaatgcagcatctgcaagcagggcaaggaagtttgtatacgatgtctggtaattcaaaaccagaatgaatgattctaaggaatgagcagctgcagcaaccggtcctgccagggttggatccacatgcccttggtacagcggtgtacagatgaagctgattattcgacaagggcattgacaggaagagagttggtcatggcatttgcaggttttgtgaaaaatgtagctggactatccaagtgatgttgcaaggcattttgcttttgtctttggaaaccatgtaaattaccactggggctagagttctgggaagatagagatcaatatagaggtacgcgtacagggctcgtgtctttccatttctagtacctgtcgggtttttttttcccaattttttctttctctttcatggtctcccagcatatttgtcgagggaccttatttcttttttggcccagtagattagtgcatgtattactacccttttcagatcaaagggcgttgcaatcatttttatgggcaa

SEQ ID NO: 16302 - DNA, 707 bp, Malus x domestica
  misc_feature (42)..(42): n is a, c, g, or t
  Predicted polypeptide sequence is orthologous to G447
atttcatgctgctgatttttacaatgtacttgagtgggaganatttcaatctgaaaagcaaaatggcaaatgaattttaaaattgacttcagacatcatcgttgtatccgcgaatataaaacatgccgtaccagattgttcactaggccggaaatttgccctcccttgaacagaactcgggaccaactagaaccacaagaaatttcggactaggatcctctgttcagaacttcagcttctctcccgtgcttatgtaagagctcggccagaaagttagatgccaaccttaaccatgaaataccacttctcaaactgcttgctccagcaactagtaacggctaagtcaccggaaaggtcaaactttgatctttatgccatgctgattaccgtgaaagattttcctataagcatctaaagctcctactagggagaaaactgtcagcgtattggcatgctacattaggcattcccaccatccgagctgctgcaagcttggtttgggagcacagcgttgccgccaaaatctccatccaaactcatctgctggacttcttgcggggaaaggatcttgatgcagcgaacacagttcacaaactcctcccaagggtcatctccaactagcagaacatcattctcatgatctacatacacaagtttccagcccaccctccctcggtcctctaactgtccctctataccaaaccgtc

SEQ ID NO: 16303 - DNA, 637 bp, Malus x domestica
  Predicted polypeptide sequence is orthologous to G447
cacgaggccggcatgatcttgcccgcatgttcgggattgaagggcaactagaagatccacacaggacggactggaaacttgtatatgtggatcatgaaaatgacattcttcttgttggcgatgatccatgggaggagtttgtgagctgtgttcagagtataaagatattgtcatccgttgaagtacggcagatgagcttggatggagatctcggcaacattccagtccccaatcaagcttctagcggaactgacagtggaaatgcatggagacctcagtatgatgataactctgcagcctcgtttaatcggtaagggttcaaatggtgaaatgatcaagtcttcggcagatgaaattcaatctggtttgcaactgtgagctgtaatccatgtgagcggaatccctctcgtgcgatactgatacaacgatcagaactggagtctctccaatcattgagggataaaattgttcgttgtccgttcggtgtgaaaactactgattccacgggtttggcgaattgagttcctttaatttccaatagcaggtcagtaggagctcaaaaatatctctaacactctacagtgacttagtcgtaatccttgcatatattattgttgatgtgtagcttcataagtga

SEQ ID NO: 16304 - DNA, 635 bp, Malus x domestica
  misc_feature (539)..(539): n is a, c, g, or t
  Predicted polypeptide sequence is orthologous to G450, G456
ggttttctgaaactgagagtaagattagtactgatactagtacttgtgtggatttgaagcttaatctttctaatagttctaaggaggcaaatagtactggtgggaaagatggcattgctgttaagtccaagacgaacaaggagaagaacaaccaccttgatcttccggcttccgatccagcaaagcctcctgctgccaaggcacaagtcgtgggttggccaccggtgcgttctttccgaaagaacatgttcacgggggtgcaaaagagctcaaatgacggagaaagtgagcagatgaacaagggtggcaataataatgcagttctggtgaaggttagcatggatggtgcaccctaccttcgcaaggtcgacttgaagatgtacaagagttaccctgagctctctgatgccctagccaaaatgttcagctccttcaccattggaaattgtggatcccaaggaatgaaggacttcatgaatgagagcaagctgatggatgttctcaacggttctgattacactccaacatatgaagacaangatggtgattggatgctggttggcgatgtcccgtgggagatgtttgttgaatcatgcaagagattgcgtataatgaagagcaaggaggctgttggg

SEQ ID NO: 16305 - DNA, 854 bp, Malus x domestica
  Predicted polypeptide sequence is orthologous to G450, G456
aacaacgcaacaacgcaacaagacagaagaaagaagaagcagcaacgaaagcagctctacgcatcaccaccaaattaagcacaagcttagagaccctcgcaggctttttatatacaagcactttcttcaaaatttcattattcctgttagccggaagatgacgagcatgcttggagttgagtgtgatttgaacctcagagagactgagctgcctagggctgcctggtggtggtacttctactgtggctgagccggaaactaaggctaccggaaagagaggcttctctgagaccgttgatctcaagctcaagcttcagtccaaggatgatctgaatgacaatgtaaaaaatattgcttccagggagaagaacgacctcctttcttgcacaaaagatccagcaaagcctccagccaaggcacaagttgtgggttggccaccagttcgatcataccgaaagaacataatggcgcagaagaacaccagcgaggaaaatactgagaaggcaaccgtcggtggcggaggctgcagcgctgcgtttgtgaaggtttgcatggatggcgctccatatcttcgtaaggtggatttgaagatgtacaagagttaccaagagctctctaatgccttagccaagatgttcagttccttcaccaccggttactatggggcccaaggaatgatagacttcatgaacgagagcaagttgatggatcttcttaacagttccgagtatgtgccaacctatgaagataaggacggtgattggatgctcgtgggggacgttccatgggggaagttcgttgattcatgcaaccggctgcgaaaatggaagggtcagaagcagttggaacttgcc

SEQ ID NO: 16306 - DNA, 711 bp, Malus x domestica
  Predicted polypeptide sequence is orthologous to G450, G456
tgatttgaagctcaatatttcatctgaagatcaatcggctggtgatgaagatcaagcggggagatgaaggagaagaatgttgctcctgttcctaggtcaaatgatccaactaagcctcctgctgccaaggctcaagttgtaggttggccccctgtccgatcattccgaaagaacatcctgaccgtccaaaagaatagctctgaggagggtgaaaataccaacagcatcagtgcagcatttgttaaagtcagcatggatggcgcaccctacttgcgtaaagtggacctgaagttgtacaaaagctaccaagagctttctactgccttaagcaaaatgtttagctccttcaccattggtaactgtgggtcacaaggaatgaaggatttcatgaacgagagcaaactaatagaccttctgagtggttctgagtatgtgcctagttatgaggacaaggatggagattggatgcttgttggagatgtgccatgggaaatgtttgtcaattcatgcaaacgcctgcgaataatgaagggatctgaggctatcggacttgcaccaagagcggtggagaagtacaagaacagaagttgaagaagttgctagattgccgtgggttgatatttctgccatggacacaatcaaatgaaagcagaccggctctacacagatggagagcacgaggtttggatgtctgtgactctgtatttttgt

SEQ ID NO: 16307 - DNA, 771 bp, Malus x domestica
  Predicted polypeptide sequence is orthologous to G450, G456
tggtggacatgaagaaggagaaggatgttgctcctgttcctaggtcaaatgatccaactaagccccatgctgccaaggctcaagttgtaggttggccacccgtccgatcattccgaaagaacatcctggccgtccaaaaggatgtctcggatgagggtgaaaagaccaacagtatcagcgcagcatttgttaaagtcagcatggatggcgcaccctacttgcgtaaagtggacttaaagttgtacaaaagctaccaagagctttctactgccttaggcaaaatgttcagctccttcaccatcggtagctacgggtcacaaggaatgaaggatttcatgaacgagagcaaactaatagaccttctgaatggttctgagtatgtgcctacttatgaggacaaggatggagattggatgcttgttggagatgtgccatgggaaatgttcgtcaattcatgcaaacgtttgcgaataatgaggggatctgaagctattggacttgcaccaagagcggtggagaagtgcaagaatagaagttgaagaagttgctagattgctttgggttgatgtttcggccatggacacaatcaaatgaaagcagaccggctccgcagagatggagagcatgaagtttcgatgtgtctgtgaccctgtatttttttttttctttttggtccttctaatgtttttaactaaagttaagaatatattctgagatttgttagggacgacaagaagcaataatatatattatagatgttcataaaaaaaa

SEQ ID NO: 16308 - DNA, 812 bp, Malus x domestica
  Predicted polypeptide sequence is orthologous to G450, G456
tcacattgaagtaaaagcaaagcaaaagctctcaaaatgttaccggaaaataagcagcagccgccggacggactgaactacgatgagacgaagctgaccttagggttgcctggttcgggctcgaaacgtggattctcagagaccgttgatattagtcttgggagctcgagctcatcgtcgccaagagcaggggtggaatgttgtgatcaatatagtgttgttgatggtggggacaaaactcataaggctccagctaaggcacaagtggttggatggccaccagtgagagtttcaaggaagaacttgatgaacagctgcaaatatgtgaaagtggcagttgatggagctccatatctgcgcaaggttgatcttgagatgtacaacagctatcagcagcttttgggtgctcttgaggacatgttttcgttcttaaaaatccgtaattacttaaatgagagcaagcttatggaccctgcaaatggggtggaatatgtaccaacttatgaagacagagatggcgattggatgcttgttggagatgtcccatggaaaatgtttgtggaaacatgcaagcggctccggttgatgaaaagctcagaggcgatcggattagctccgaggacgcctccgcaattcacaagcacacactgaaaaaaggccttttactgttttacatatggatgagagagaagaaagagaaaaaaaatggaaaaaataaaaagggagatggtttgtaccggaaggcttttctctttcttgtgttcggggggaaattttggattttaaatgaaaaaaaaaaaaaaaaaaaaaaa

SEQ ID NO: 16309 - DNA, 396 bp, Malus x domestica
  Predicted polypeptide sequence is orthologous to G451
ccgattttttttttttttttttccgtttatcgtttcttttctttgtacaactctccttgaagagaacatgaacaaactatacatgaaaatttgccttgttcttctaacaattccttgtaaatattttctattacaacataacaaagtttctgtttctaaatcgaaagcccgagctggatgtcttcatgaaagcaaacatgactgtaaatcttctgattttgtctaattgttctttgatcacggcgtgcagcagcctaaccctttcgcatccgaacctttcatgattcacaacctcttgcacaaaacgatgaacatctcccatggaacatctcccccaagcatcaaatcacaaactttgtcttcataagaaagcaaaaattctgatcggctattata

SEQ ID NO: 16310 - DNA, 587 bp, Malus x domestica
  Predicted polypeptide sequence is orthologous to G451
gaaaaatcatggcaatgtttgcgcaggatcttgaagccacggagctaagattagggttaccgggcaccaatgattccgagcagaacacctcttctcctactttggttagcaagagtaacaaaagaccactgcaatccgacatgaacgaagacaatgattcttcacccgccaacagatccgacgagcaaatttctcagcctccacctaccaagacacaagtagtagggtggccgccggtgagatcatactggaaaaactgcctccaatcgaagaaaaccgaggcggaggcagccggcatctacgtgaagataagcatggatggagctccttatctaagaaagattgatttgaaggtgtacagaggatatcctgagctgcttaaagcattggaagacatgttcaagttcaaggttggtgattactgtgagaagaaattagggtataataaccgatcagaatttgtgcctacttatgaagaacaaaatggagattggatgctacttggagatgttccatgggagaagttcatcgtttcgtgcaaaaagttgagaatcatgaaaggttcggaagcgaaaaggttaggctgc

SEQ ID NO: 16311 - DNA, 556 bp, Malus x domestica
  misc_feature (187)..(187): n is a, c, g, or t
  Predicted polypeptide sequence is orthologous to G451
ctggttggagatgttccatgggatatgttcatgtcatcctgcaagaagttgagaatcatgaaaggatcagaggccagaggtttggggtgtggcgtatgaaaaagacatgtcaacccaaaagatcaaggggagaaggaaagatatatcatctctctctctctctctctctctctctctctctctctcnatctcatgatatgcatggagagaaaaatttacctcacagcttgggtaatcgacgaagatattcagattttagtctccttaatgactgacatatcttctctggagttgattgggattgtaaacagaagcagaagataatctagctggtgaagtaattacaaattcattccttaagtttggcacctagatttgtttgcggtttgcgcatccgtgattgatgctgtatcgtattgtttcttatgattcagtcagaccaaaactgcataaagagattttggttctaaagagatcgtataaaaaggaagaggcttgtttcatgttttggctatgagtttgtactattgatatttgatatggatcaatatatatg

SEQ ID NO: 16312 - DNA, 665 bp, Malus x domestica
  Predicted polypeptide sequence is orthologous to G451
ttcaaaatctctcacaagaaacccttaacacacctttctgtttatctattatccttctgcaaatcagtctgcaatctgcaaaagcattagggtttatttagcaaagtgattaagatggaagaccagctaaatttcaaggcaactgagctaagattagggttgcctggaagctctgaagagcctgagaacaaaaaagcagcaccgtctcctcctatggctaagaataacaagagggcttcgccggattcagcggctgaggagtgcagtacaagttctgatcccatagatgtccctcccaccaagtaagcaatgttcatacatggactatgagttttatgttaataattgattaagaaggtttagttaagtggttatgttgctaatttatgattgaataaatgtgagcaggacacaggtagtagggtggcctccaatcagatcttacaggaaaaacagtttgcaactgcgagaggcgtacgtgaaagtaagcgtcgacggagctccttatctgaggaagattgatctcaaggtttacaatagctaccccgaactcatcaaggccttagagaagatgttcaacctagccaatattaatggatccgattttgctccgacatatgaagacaaagacggcgactggatgcttgttggaaatggccatggaa

SEQ ID NO: 16313 - DNA, 655 bp, Malus x domestica
  Predicted polypeptide sequence is orthologous to G451
ccctctcctcaaagcctccatcaccgaatactcacgacttggttatttgctagttcaccgtcaaagtttgagcagaagaacaatctttgaagaaacacacagagaaatcatggcaatgtttgcgcaggatcttgaagccacagagctaagattagggttaccgggcaccaaggattccgagcagaacacatattctactactttgattagcaagagcaacaaaagaccactgcaacccgacatgaacgacgaagacaatgattcttcatccgccaaaagatccgaccagcaaatttctcagcctccaccttccaaggcacaagtagtagggtggccgccggtgagatcataccggaaaacctgcctccaagcgaagaaaaccgaggcggaggcagccgggatttatgtcaagataagcatggatggagctccttatctaagaaagatagatttgaaggtgtacagagggtatactgaactgcttaaagcgttggaagacatgttcaagttcaaagttggtgattattgtgagaaggatttagggtacaataacagatcagaatttgtacctacttatgaagacagagatggagattggatgctgcttggagatgttccctgggagaagttcatcgcctcctgccagaaggtgaaa

SEQ ID NO: 16314 - DNA, 601 bp, Malus x domestica
  Predicted polypeptide sequence is orthologous to G464
gcaactagaccctcaaaattgctggatggatcatttgagtttgcgctcacttacgaagataaagatggagactggatgcttgtgggagatgttccttgggagatgtttcttggtactgtgaagaggttgaggattatgaagacatctgaggataacggacttgctccgctgttacgggaaaagaatgtgaggcaaagatgtaagccaatctagatcgtttctcataacacaagcaagaagagacaacctatgtttgaaagtgtacaaagtggacaaaacccatagtaggagcattttggaaagaagagggagaaaccgttggttttcgggttcatttttggtgctgtcgaatgccattttgttttgtttttgttacgccttctccgagatcgatctccctaccttttgaaaaccacagccaccgtagttttcaatgtaatactgctatatatatacgttgcttactttggtgaatgttgtgtaagttgtatatatgggaacgccctcaaatgctcgtctgttcagcagacgagcaattttgggtttcccccttgttttatggagagaaaacaagagatatttgttaaatggaaaaaaaaaa

SEQ ID NO: 16315 - DNA, 840 bp, Malus x domestica
  Predicted polypeptide sequence is orthologous to G470
ctgtgaaccctaaagatggaaactgcaagctttttggcattcccctgataacaccagatcctgcattgttacacagaaatatgatgaatgagtcacctcgtaataaccaagctcatacttttgagtctgacctgaattctgaaaaatcaaggggcttaaaatcaacagataatctcgtggctgtcagtgagccagctttgcaaacttctcagcaacatatcagagatgttcagggtaaatcacagggtggttcaactatgagttgtactaaggttcacaaacatggtattgcactaggtaagtctgttgatcttaccaagttcaaccactacaaagagctgagacctgaattggacatgttgtttgactttggtggggagcggatgtcgcctaggaacaattggaggatcgttcacactgatcacgaatgtgagacgaggcgtgatcgccactatctctcccgcggggttcgtagggctgtcccgaacatttccctcttcaccaaaaactaagtccccaccaatcaccctgtgaccctcgacgaaccgtgcgaagtcccaaccatcatccggtgcatacggcgagtctatccccaaaccagcaaccatccactcttatccacctccctcataaaccaaaatatactcaaaactaccacctacaacatcaacacccaacactaatccttcctcatcataccacaactctcaaatattatcttaatcattaataaatatataataagtatatccacactctcctcttcttaatcttcactatttctttactctaccaaactcataacacacaccacttacatactagcacacattctcactc

SEQ ID NO: 16316 - DNA, 465 bp, Malus x domestica
  Predicted polypeptide sequence is orthologous to G475
aaaaatatggattcaggcagagctcatggaaagaggaccatgtcgaaatacgaggtggaggaggaggaggaagaggaggaggaggaagaggaagaggaggaggaggaggaagaagaaagtaggagtaggagaccatcaatagtgtatggtgaggatgaggggagagcaagagtgacgatggtgaatagtactgctgctactcctacagggagaagatctggtgcaggagggtctacggcagggccatgttgtcaggtagataattgcactgctgacttgagtgatttaaagcaatactaccgccgccacaaggtctgtgatgttcatgccaaggctccgtcgatagtcgtgggtggattccggcagcgtttttgccagcaatgtagcacgtttcatagcctgtcagagtttgatgacagtaacaggagttgtcgcaggcgattaactggacacaatgagcggcgg

SEQ ID NO: 16317 - DNA, 611 bp, Malus x domestica
  Predicted polypeptide sequence is orthologous to G477
ttttttttttagcgtaataatatcttaaatcactggattaccgtaaaagtttgcagataacaaacataaaggcatctatagcaacttacaaaaatccagcttaccacatcaaaactagatagctatattttcctttcggaatagggtgttgctaccactggtatctaaagtttctcccagcctgtggaaatgttggaattctgatgctgaagatccaaactgcctccagcaacataatcacgttgttgcttgcatgcctgtcgggaaacagtagaattttccattttcctgctttacttggagaaagttcctctcatgctccactctctgaaggtgtgatgacaattgcagcaaattaaaagttgttccgcgttcaggagaaacacaatacttggcactcaagcaatctgacacatgataagctctgtctgtgtgaagttggaagtcagcagcatgactagaatcagaaatgtttactgattccatgtggttggctcccatagatttcttactaaacgggtaggacctgtttcgtccacaattttccatggagtttaccctcgaagtcttttcattaagttgaccaaaacagtgatgggctctttgattga

SEQ ID NO: 16318 - DNA, 728 bp, Malus x domestica
  Predicted polypeptide sequence is orthologous to G477
cgttgctgtcgaaaagttgaaggcgggactcattatgggccttttttggggatgcctgttgcaaacgggcatctgcattcgaaacctgtcctcccttcttacgatattggcaaacagtatcccccatttcatgaaaacggaactaatcctcaaaatgcaagcatatttggtcagaacggtagtcaatatccacaagatgcgagaggcctaagttccggttcacattctatttttcatgagaccgcattaggaagtcaaaacttcaatgtttttgacactgcttcagcagttcaaggattattgggaatctcagactctggctgtgctctctctcttctgtcatctcaatcacagaactcttcaggctatttgtcaggaattcctattgcgcgtcccttagtcataccagccagccataacttcccttcttcaggaatgaattctggagctggcaatcacctgagtcccatgccgctatctaatggttgtgatgataccgatgattttggaatctcaaatgggattttccaaggatcaggttttgtgaacacaaaagatcgtctaccctttcaagatggagccactatcaacttgcttcaactgtcatcgcagctccaacgagtagaggatcaacggcaatccatgctggtgaagcaggaaaatgatgctttctgctttactgagaatcacttaaaaagtgatctgcaaataaaggtaaattgatgtgt

SEQ ID NO: 16319 - DNA, 566 bp, Malus x domestica
  Predicted polypeptide sequence is orthologous to G483
ccaacacaatggcgaaatattcatattggagctgactttgcgctcgtggattcacacagaggagaacaaaaggaggacattacaaaagaatgatatcgcagcagctatttcaaggactgacgtctttgattttttggttgatattatcccaagagatgagttgaaagaagaggcacttggcgtgaccaaggctaccctcccagtggtgggttccccggcagatgttccatactattatgttccacagcagcatcctgtgggagctcctgggatgatcatggggaagccagttgatcaagcagcaatgtatgcttctcaacagcctcgaccacctgtgtctttcatgccgtgggctcagtctcaacctcaacagccgcagcaacagcaacaacaggcccaacagcagcagacggacacttaatgattctggccaaagctgttgtcaaagctgttcctgggcatagtgtcttatcgttagtgatgagttttagtaccgttggattagttggcgagtgtgacactacaccctagtggattgtgcagtgcagctaaagttaggtttattg

SEQ ID NO: 16320 - DNA, 466 bp, Malus x domestica
  Predicted polypeptide sequence is orthologous to G484, G2631
aacaacacaaactggagactatgcatgacctatcaaaaagtgtcaaatgggggaacggagtggagatgacagaggaagaagccttggctgagcagcagaggatgtttgccgaggcacgtgcaagaatgaatggtggagccaccgcgcccaagcaaccagaccccgaacaaagtttagagagctaactttaggaccttttatttttcgtgaaccgtaggcaagtatcctcgacttatccatatgtgcttctcttatatgtacaaaagaaagaagaagaaaaaaacccattcagtagtgagtgagctggcctatgtccttatgcacgcgaagttgtattttctttatggatccttgtctataagttcatgtaactagtaagagtttgtacgactcctggtgccgcaactgtatgtaattatttggctttgtttagtcattagtttggaaaaaaaaaaaaaaaaaatcg

SEQ ID NO: 16321 - DNA, 533 bp, Malus x domestica
  Predicted polypeptide sequence is orthologous to G484, G2631
aagaacctaacgcccttcccctgataaatccatatattcaacaccatggcccccttccgattcttgatcttcctgcaactcgtatcgccgtcgatcggttgattgattcgtcgtctacgccgtccgattcgtgttctctcgctctccgattcaactcggttatcaagtcaggtgttgtttttgagagttttacggtgtgcgctggttcaggatggatccgatggacatcatcgggaagtcaaaggaggatgcttcgcttccgaaagcaaccatgacgaaaatcattaaagagatgttaccaccagatgtacgcgttgcaagagatgctcaagatcttttgattgagtgttgcgtagagtttataaatctcatctcgtcagagtcaaatgaagtttgtagcagagaggagaaaagaacaatagctcctgagcatgtactcaaggctttacaggttcttgggtttagcgagtacgttgaggaagtttactcggcatatgaacaacacaagcttgagactatgtcatgatcttccg

SEQ ID NO: 16322 - DNA, 591 bp, Malus x domestica
  Predicted polypeptide sequence is orthologous to G489, G714
accagcaacaacaacagcaactgcagcaacaactccaaaaattttggggagagcagcataaagaaattgatcaaactaatgatttcaaaaaccatagtttgccattggccaggattaagaagattatgaaagcggatgaggatgtgaggatgatatcagccgaagctcccgtcatatttgctagggcctgtgagatgttcattctagagttgacaatgcggtcttggaatcataccgaggagaacaaaagaagaacactgcaaaagaacgacatcgcagcagcaattacgcggacagatatatttgactttcttgttgatatcgtcccaagagaggatttgaaagatgaagtacttgcatcaatcccaagaggtgggaatctcccagttggggttccatctgatggtgttccttactattacatgcctcctcagcatgctccacaggttggtgctccggggaatcaaaatatgtatggccaacagacacatgcgtacattgctcaaccaacatggccacatcaacaacagcaaccgcacgaagatatcgagtaaaagagataatggagtataaaaccagaacatcctttga

SEQ ID NO: 16323 - DNA, 609 bp, Malus x domestica
  Predicted polypeptide sequence is orthologous to G502, G519
atctgagaagaagcaaattagcaagagcaagaggaaagagaagaagaaaggaaaagggaaggagtaaaagcgaaacagtaaaaagtaatcatgagcggaggaggagacgagcagcagcagcagcagctggagttaccgccggggttcagatttcacccgacggatgaggaactggtgaaccattacttgtgcaggaaatgcgcttcacagcctctcgctgttccaatcatcagagaaattgatctttacaaattcgatccgtggcagctccctgaaatggcactttacggagagaaagaatggtatttcttttcgccaagggacagaaaatatccaaacggttcaaggccgaaccgggcagccggaaccgggtactggaaggcgaccggggctgacaagcacattggaaaacccaaggcactcgggattaaaaaggcactcgtgttctacgctggtaaagcccccaaaggaatcaaaaccaattggatcatgcacgagtaccgcctcgccaatgtcgaccggtccgccgccgctgccaagaaaaatcaaaaccggaagcttgatgattgggtactatgccgcatatacaacaagaaggggcacatagaa

SEQ ID NO: 16324 - DNA, 583 bp, Malus x domestica
  Predicted polypeptide sequence is orthologous to G502, G519
cgatatcagttccgatcattgccgaaatcgatctctacaaatacgacccctgggagctcccaggcttggcgttgtacggggaaaaggagtggtatttcttttcgccaagggatcggaagtacccgaacggttcgaggccgaaccgggcggccggaagcggctactggaaggcgaccggggccgataagccgattgggcacccgaaacctgtggggattaagaaagctctggtgttctatgctggaaaagcccctcgcggcgaaaagaccaactggattatgcacgaataccgcctcgccgacgttgaccgctcgccgaggaagaagaacagcctcaggctggatgattgggttctgtgccgaatatacaacaagaaggggaccgtggagaaccagcagcctcagcagcagcaagaacaacagcgaacgactagtcgtaacgcgagcagtggctcggagttcgaggacaggaagccggataatctgaggtgcccgccgccgccggcttccgtggtccccagtcgtcacgtgagcgattacgtgtacttcgacaactctgactcggtgccgaagctgcacacgga

SEQ ID NO: 16325 - DNA, 590 bp, Malus x domestica
  Predicted polypeptide sequence is orthologous to G504
ctcgagtttttttttttttttttaaaaatttaaatcacatgttcattaaaaaaaatataataacataaaacatatatacgaaaccttaccaaaaccaaactaggaattccagttcatgcttgggagttgaaactgtgggcgcaaaaccccatctcctagcaactcaagaagtgcagcattagcgtgaaacggtgccgtgccctgtggcgtctgattcagcatagaaacaaatgagttgttttcattgatgagatcagcatgaaactttttgctcgatgaagtagtagtagcagcagcagtccctatcgatcccacgtcgttccaaaacggcgaaggaagatgacgtttcaagggtaggctgctttttgagatggaagttgatatagtgccaaactgatcatgatcatgagagtgagagcctggttgatgatcgcttgacgatagtatgccctcaagatagctctcgtgatcatcgctttctagcaacgcggtgtaatctgtagttggcagctttgatgatggtggcggcggcagcggcggcagtttttgagttggcagtattgacgggtggagaaacataccctcttcca

SEQ ID NO: 16326 - DNA, 742 bp, Malus x domestica
  Predicted polypeptide sequence is orthologous to G536
ccccatttccctgatccgtttccaatcctcccaatggcggcctcatccccgcgcgaagaaaacgtctacgtcgccaagctcgccgagcaagccgagcgctacgaggagatggtcgagttcatggagaaggtcgtctcctccctccccgaaggcgaggagcccaccgtcgaagagcgcaacctcctctccgtcgcctacaagaacgtcatcggcgcccgccgtgcctcctggcgtatcgtctcctccatcgagcagaaggaggagagccgcggcaacaccgaccacgtcgccaccatcaaggagtacagagctcggatcgagaacgagctctccaacatctgcggtgggatcctgaaggttctcgaatcgaagctcgttccgtctgcgaaagtcggagagtccaaggtgttttatctgaagatgaaaggggattaccataggtatttggctgagttcaaaactggggatgagcgtaaagaggcggctgagaacaccctcaatgcctataaggcagcgcaggatattgcaacctctgagttggctccaactcatcccatccgtttaggattggctttgaacttctctgtgttttactacgagattctaaattctcctgaccgggcttgcagccttgcaaagcaggcttttgatgaagccattgcagagctggatacactgggagaggattcatacaaggatagcactctgataatgcaacttcttcgtgataatctcacattgt

SEQ ID NO: 16327 - DNA, 586 bp, Malus x domestica
  Predicted polypeptide sequence is orthologous to G536
tttcagagagaaaggctatggagatagagagagagaagcatgcttaccacgcgaaacttgccgagcaagccgaaagatacgacgagatgattgaagaaatgaagaaagttgccaagttggatgtggaattgagcgtggaggagcgaaatttgttgtcagttgggtataagagtgtgatcggggcaagaagggcgtcatggcggatactgtcttccattgaacaaaaggaagaggccaagggtggtgaacaaaatgtgaagaggataaaggagtacaggcagagggttgaagacgagcttgcgaaaatttgccatgacatactaacagttgttgattatcaccttctcccctcttcgtccactggggaatctactgttttttaccataagatgaaaggagattactatcgatatctagctgaattcaaatctggtgatgatcgcaaacaagctgctgatcactcgcttaaagcctatttgactgcggttgatactgctgcctctgagttgcccccaacacatccaatcaggctcggcctggctctaaacttctctgttttttactatgaaattctcaactccccgga

SEQ ID NO: 16328 - DNA, 827 bp, Malus x domestica
  Predicted polypeptide sequence is orthologous to G536
ttgagagttcacagagaccagagagagagagaggaagtgagagagtgagatcggccatggcttcccccaaggagagagagaactacgtctacactgctaagctcgccgagcaagccgagcgttacgacgaaatggtggaggcgatggcgaaagtagcgaagcttgacgtggagctcaccgtagaggagcggaatctgctttcggttgtgtacaagaacgtgatcggagctcgcagggcttcgtggagaattctgtcctcgattgagcagaaggaggaggggaaagggaacgatcagaatgtgagccgtatcaaggagtacaggcaaaaggttgagtccgagctctccagcatttgcagcgacatcatgagggttatcgatgagcatctcattccctcgtgcaccgcttttgagtccactgtgtttttctacaaaatgaaaggagattactatcgctacttggcggagtttaagactggtgatgataggaaagaggttgctgatcagtcgatgaaagcttatcaggcagcttctagtaatgcagagagtgacttaccccccacacaccccatcatactctggttggccttgaacttctctgtcttttactatgaaatattgaactctccggaaagggcttgtcaccctgcaaggcaagcttttgatgaagctatcctcaaaattagatactttgagccaggaaacgtacaagggataccccttggatctggcgcttttaagggacaccctactttgtggacttcggacattccaaaggaatgaaccaaggatttccagaaggggatgggcctgtcaactttgggggga

SEQ ID NO: 16329 - DNA, 751 bp, Malus x domestica
  Predicted polypeptide sequence is orthologous to G536
atcccctcgcgaagagatcgtggacgtcgcctagctcgccgagcgagccgagcgatgcgaagagatggttgagttcatggagaaggtcgtctcctccctccctggaggggaagagcccaccgtcgaagagcgcaacctcctctccgtcacctacgagaacgtgatcggcgcccgccgtgcctcgtggcgcatcgtctcctccatcgagcagaaggaggagagccgcggcagcagcgaccacgtcgccactatcaaggagtacagggctcggatcgagaacgagctctccaacatcggcggtgggattctcagggttctcgaatccaagcttgttcctgcggcatacgttggagagtccaaggtgttttatttgaagatgaatggagattaccataggtatttggctgagttcaaaactggagacgagcgcatggaggccgctgagaacaccctcaattcctataagtcagctcaggatattgcaacctctgagctggccccaactcatcccatccgtttaggattggctttgaacttctctgtgttttactacgagattccaaattctcctgaccggggttgcagtcttgccaagcaggcttttgatgaagccattggcaagctggatacactgggagaggattcctacagggatagcactttgattatgcaccttccttcgcgaaaaatctccaattgtggacttcggaaaatgcagggagaggggaacgatgaaattaaacaagcaccc

SEQ ID NO: 16330 - DNA, 727 bp, Malus x domestica
  Predicted polypeptide sequence is orthologous to G536
aatcacactatccttctgagatctccagatccgatccctccatcgaccaacaatggcggcaaccaccccctccccccgcgaagagaacgtctacatggccaaactcgccgagcaagccgagcgctacgaggagatggtcgagttcgtcgagaaagtctccgcctccgccgataaagaggagctcaccgtcgaggagcgcaacctcctctccgttgcctacaagaacgtcatcggtgcccgccgtgcctcctggcgcatcatctcctccatcgagcagaaggaggagagccgcggcaacgacgaccacgttgccacgatccgtgactaccgatccaagatcgagaccgagctctccaacatctgcgacggcattctcaagctcctcgactccaggctcatcccctccgctgtcgccggcgattccaaggtcttttatctcaaaatgaagggcgattaccaccgttatcttgccgagttcaagaccggcgccgagcgcaaggaggccgccgagagcaccctctccgcctacaaggccgctcaggacattgccaatgccgaactggcaccaacacacccaatccgcctggggttggctctcaacttctctgtgttttactatgagattctgaactctcccgaccgcgcctgcaatctcgccaaacaggcttttgatgaggcgatcggcagagtgggacactcccggaagagggagtcatacaaggaaagc

SEQ ID NO: 16331 - DNA, 1090 bp, Malus x domestica
  Predicted polypeptide sequence is orthologous to G536
gttttgcttggagcttagatcttctgcttcctcgtggaccagagaaggtttcagatttagacttacatagcaaagatgtcgccaactgattcttcacgcgaggagaatgtgtacatggccaagttggccgaacaggctgagagatatgaggagatggtcgagtttatggagaaagttgccaagactgttgatgttgaggagctaacagtggaggaaagaaatctcctctctgtggcttataagaatgtgattggagcgaggagagcttcgtggaggatcatatcttccattgagcagaaggaggagagcagagggaatgaggatcatgttgcgattatcaaggaatacaggagcaagattgagactgagctcagcaagatctgtgatgggatcttgaaccttcttgagtcgcacctcattccatctgcctcatctgccgagtccaaggtgttttacctcaagatgaaaggtgattaccacaggtaccttgctgagtttaagactggaggtgaaagaaaggaagcagctgagagcactttgttggcttacaagtctgctcaggatattgccctggctgagctggctccaacccacccgataaggcttggacttgcacttaacttctcagtcttctactatgaaatccttaactcaccagatcgtgcttgcaatctggcaaaacaggcttttgatgaggctatttctgagcttgacacattgggtgaggaatcctacaaggatagcactttgatcatgcagctcctccgagacaatctgacactctggacttctgatatcacggatgatgctggggacgaaatcaaggaagcatcaaagcgcgaatccagtgaaacacagcagtaacgaggcttctggttcgtagaatttgtactatgtacccatttatcttgggacctttgtaatagatgccatgtgggttgtagaaggatttgcctatgaacttgacggtcttgagcgcgtcagcgcttagggttgaaatgttccagcctagggttggaatgttccaacagatcgcaaaattgcgttttataattggtgagaagaatttggttcagtgcttaaaaaaaaa

SEQ ID NO: 16332 - DNA, 669 bp, Malus x domestica
  Predicted polypeptide sequence is orthologous to G536
cacgaggcacctcttcctcctctctccaactctttcgctgctcagctcctccaatggcttccgccgtcccagaaaacctcagccgcgaacagtacgtgtacctggcgaagctcgccgagcaggccgagcgctacgaggagatggtgagcttcatggagaagctggtggtgggctccaccgccgccgggaccgagctgacggtggaggagcgcaatctgctcagcgtcgcctacaagaacgtcatcggctcgctccgcgccgcctggcgcataatctcgtccatcgagcagaaggaggaaggccgtcgcaacgaggagcacgtggcgctcgtcaagcagtacagatccaaggtggagactgagctctccgccatctgcgctggaatcctgaagctcctgcaatcgcaccttgttccttcggcgaccaccggagagtccaaggtcttctacttgaagatgaagggcgattatcatcgatacctcgccgagttcaaaaatggcgacgagaggaagaccgccgccgaggacaccatggttgcatacaaggctgctcaggatattgcggtgagtgatttagcgcccacgcatccaataaggttggggctggcgctcaacttttcggtgttttactacgagatcctcaactcctcggagaaagcttgtagcatgg

SEQ ID NO: 16333 - DNA, 681 bp, Malus x domestica
  Predicted polypeptide sequence is orthologous to G536
cacgaggaaaaataccagtaatctttgattaaggaaaaaaaaggtactaggaatcatcatgtactactctcattaccaaaccaaacaaattataaggaaacatttcaacatgagcatatggtatgcacataaggacatcaatgtaaatagagttgtctgcagattacagaatatttatgacattcaagcccacctccctcaaggagcgtaacaatcccgtgcttaagcctcgtccatctgctcctgcaaatctgaagtccaaagagtgaggttgtccctcagcagttgcataatcaaagtgctatccttgtacgattcctctcccagtgtatcaagttcagcaatagcttcctcaaaagcctgtttagccatgctacaagctttctccgaggagttaaggatctcgtagtaaaacaccgagaagttgagcgccagccccaaccttattggatgcgtaggcgccaaatcagccagcgcaatatcctgagcagccttgtaggcaaccatggtgtcctcggcggcggtctttctctcgtcgccatttttgaactcggcgaggtaccgatggtaatcgcccttcatcttcaagtagaagaccttggactctccggtggtagccgaaggaacaaggtgcgactgcaggagctccaggattccggcgcagatggcggagagctcggt

SEQ ID NO: 16334 - DNA, 1437 bp, Malus x domestica
  Predicted polypeptide sequence is orthologous to G549
tgctgtgtggagttgtggaaaatatggatccagatgccttctctgcgaacttgttcaagtggggcctacgaggcatggttgtgccgacgaaccgggttcagctggaagcagccgtgccaccagcagcggcagctgctgctgcggcggctggttgtactttgcggccgccaggtgagcttggacttggaggacttgaggatttgttccaggcatatggggtcagatactacacggcggcaaagatagcggagcttgggtttactgtgaagaccctcttggacatgacggatgatgagcttgatgacatgatgagcagcctctctcagatattccgctgggagttgcttgttggggagaggtatggtatcaaagctgccgtcagagccgagcgtcgccaccttgatgaggaggactctcggcggcgcaaccatgtctctggtgataccactaccaatgcccttgatgctctctcccaagaagggctgtcggaggagccggtgcaacaagagaaggagatggtggggagcggcggaggggcggcgtgggaggttgcgacggcaggggagaggcgtaagaagcagcggaggatgaagaaggggcaatttagaaattgtagtgctggagggcgtcataataatgataataacgagggtgtggacgacgaggacgacaacgacatggacgacatgactgggcatgggaacggtggaggagggggaatgctgggagagagacagagggagcacccgttcattgtgacggagcctggggaggtggcgcgtggcaaaaagaacggcctcgattacctcttccatctctacgagcagtgccgcgatttcttgatccaggtccagaacattgccaaggagcgcggtgaaaaatgtcccaccaaggtgacaaaccaagtgtttaggtatgccaaaaaggcaggggccagctacatcaacaagccaaagatgcggcactacgtgcactgctacgccctgcattgcttggatgaggaggcatcgaatgcgctgaggagagcgttcaaggagaggggcgaaaatgtcggggcttggcggcaggcatgttacaagcctcttgtggccattgcagcaggccaaggctgggacattgatgccatcttcaattcccatccccgtctctctatttggtatgttcccacgaagcttcgtcagctttgtcacgccgagcgcaacaacgccactgcctctagctctgcctccggcggcggtgatcacctgccctattgagcaaactttatgcgcttcaatataactgataagccagttctgcagagagagtttgaacaaactaaggactgaattttatgtagtaggctagaagcctagaacaaaattttatcaatattttaggatcctgttatgatctactatttaaaaaaagctggtaattataaaagtttttgcaatc

SEQ ID NO: 16335 - DNA, 1417 bp, Malus x domestica
  Predicted polypeptide sequence is orthologous to G549
gtggaaaatatggatccagatgccttctctgcgaacttgttcaagtgggacttacgtgggatggttgtgccgacgaaccgggttcagctcgaagcagccgtgccgccagcggccacagccggtggggcggcggctggttatactttgcggccgtcaagagagcttggacttggagggcttgaagacttgttccaggcttatggggtcagatactacacggcggcgaagatagcgaagcttggatttactgtgaacaccctcttggacatgaaggatgatgagcttgatgacatgatgagcagcctctcccagatattccgctgggagttgcttgttggggagaggtatggtatcaaagctgccgtcagagccgagcgccgccgctttgaggaggaggactctcggcggcgcaaccctgtctctggtgataccaccaccaatgccttagatgctctctcccaagaagggctgtcggaggagccagtgcaacaagagaaggagatggtggggaccggagtagggatggcgtgggaggttgtgacggcgggggagaggcggaagaagcagcggaggatgaagaaggggcaatataggaactgtagtgctggagggggtcatgataatgatcataacgagggtgtagacgacaaggacgacgacatggacaacatgaatgggcaggggaacggtggaggaggggggttgcttggcgagagacagagggagcacccgttcattgtgacggagcctggggaggtggcacgtggcaaaaagaacggtcttgattacctcttctatctctacgagctgtgccgtgatttcttgatccaggtccagaacattgccaaggagcgcggtgaaaaatgtccaaccaaggtgacaaaccaggtgtttaggtatgccaaaaagtcaggcgcaagctacatcaacaagccgaagatgcggcactatgtgcactgctacgccctgcattgcctggacgtggaggcgtcgaatgtgctgaggagagcgttcaaggagaggggcgaaaatgtcggggcatggcggcaggcgtgttacaagcctcttgtggtcattgcagcagcccaaggctgggacatcgatgccattttcaattctcatccccgtctctccatctggtacgttcccacgaagctccgtcagctttgtcacgccgagcgccacaatgccaccgcctctagctctgcctccggtggcgggggcgagcacctgccctattgatcaaagttttgtgttccactgtataacttacaaaacgcttctgcggagggcgagagattttgggcaaaccaaggagggacttatatatgtactagtaaggctagggcagactgaatgaagatgttaggatctaactatgatttactaattaaaaagcttgctattttaactgttt

SEQ ID NO: 16336 - DNA, 1401 bp, Malus x domestica
  Predicted polypeptide sequence is orthologous to G549
attgtgctgtgtggagttgtggaaaatatggatccagatgccttctctgcgaacttgttcaagtggggcctacgaggcatggttgtgccgacgaaccgggttcagctggaagcagccgtgccaccagcagcggcagctgctgctgcggcggctggttgtactttgcggccgccaggtgagcttggacttggaggacttgaggatttgttccaggcatatggggtcagatactacacggcggcaaagatagcggagcttgggtttactgtgaagaccctcttggacatgacggatgatgagcttgatgacatgatgagcagcctctctcagatattccgctgggagttgcttgttggggagaggtatggtatcaaagctgccgtcagagccgagcgtcgccaccttgatgaggaggactctcggcggcgcaaccatgtctctggtgataccactaccaatgcccttgatgctctctcccaagaagggctgtcggaggagccggtgcaacaagagaaggagatggtggggagcggcggaggggcggcgtgggaggttgcgacggcaggggagaggcgtaagaagcagcggaggatgaagaaggggcaatttagaaattgtagtgctggagggcgtcataataatgataataacgagggtgtggacgacgaggacgacaacgacatggacgacatgactgggcatgggaacggtggaggagggggaatgctgggagagagacagagggagcacccgttcattgtgacggagcctggggaggtggcgcgtggcaaaaagaacggcctcgattacctcttccatctctacgagcagtgccgcgatttcttgatccaggtccagaacattgccaaggagcgcggtgaaaaatgtcccaccaaggtgacaaaccaagtgtttaggtatgccaaaaaggcaggggccagctacatcaacaagccaaagatgcggcactacgtgcactgctacgccctgcattgcttggatgaggaggcatcgaatgcgctgaggagagcgttcaaggagaggggcgaaaatgtcggggcttggcggcaggcatgttacaagcctcttgtggccattgcagcaggccaaggctgggacattgatgccatcttcaattcccatccccgtctctctatttggtatgttcccacgaagcttcgtcagctttgtcacgccgagcgcaacaacgccactgcctctagctctgcctccggcggcggtgatcacctaccctattgagcaaactttatgcgcttcaatataactgataagccagttctgcagagagagtttgagcaaactaaggactgaattttatgtagtaggctagaagcctagaacaaaattttatcaatattttaggatcctgttatgatctac

SEQ ID NO: 16337 - DNA, 629 bp, Malus x domestica
  Predicted polypeptide sequence is orthologous to G550
catattggggctgcactgtgccgggctcttggaatgtaccatgtctctcaccgtcctctactcttagccattgcactacaagctccggtccaaattccccaaccttagggaaacattcaagagacgaggacattcctaatccatccagctctgagaatgaagagcccgcaaaagataacagttccgaaagatgtgtttggatcccaaaaacattaaggatcgatgattctaatgaggctgcaagaagctctgcatgggcaacgcttggcattaggaatgaaaggggaaattgtgctaacgagggaggaggtcacttcaaggcatttcaatcaaagggagatgagaaaactcccgcagttgaagcttctcgagcgttgcaatcgaatcctgcagcgttttcccggtcactcaacttccatgagagaacatgatcaaggctgaagtttgagttgaaaactttggcaatgtgaatgtgatggaagggacccttcaaccttttgctgctgacaaatatgacaccttttttctcttgcttaccataagggaatgtttactgatcagcctctttgtttctgagttagatcatatacatgtattttcttaaatctctttgtaacaaaaaaaaaaaa

SEQ ID NO: 16338 - DNA, 496 bp, Malus x domestica
  Predicted polypeptide sequence is orthologous to G557, G1809
caaacttacagattgctaaggaacagggtgtctgctcaacaagcccgggagaggaaaaagatttacgtcaacgatctggaatcaagagccaaagaattggaggatgggaatttaaagttggaagagaagatatctacggttgttaatgaaaacgccatgcttcgaaaggttcttatgaacacaaggccaaaagtagacgaaggtattgaacaaaagcaaggatcagttaagtaagagcagacaagcataaaggagttcttttaggcagttttaggtgaatatatttagaaattttttagagatcaattccgacgaatgtgaatcacagccttcgattctccagctacatatggtatttgtgcatcacttaatttgatatgaacactcaactagctagtatggaagttttaatgaacttctgtcttctcccttttgtaccatgtatttttcatggaaaatattttttttggatgaaaaaaaaaaaaaaaaaatgcgt

SEQ ID NO: 16339 - DNA, 650 bp, Malus x domestica
  Predicted polypeptide sequence is orthologous to G557, G1809
agctcatcagccagccatagtcagtcccaatcagagcaggagatggtgaagccaaaaaccctatgttatccatctcctcctcctcctccagtttggagcaactacagcaagtacagcagccatctggttcttcttcctcgaggcctcctcatccttctcttcttcttcatagtaacaccaagaacagtaacaaactagaagagagcgatgaagatatgttcacggttccggacgtggaggcgttgccccctcctaataatagtattaataatgcggcctctacaatcgccaaagccaccagtaacaacaacaacccagatgcccagtctggctttccggccaagcgccgccgaggccgaaatcccgtcgataaggagtacaggcgactgaagagattgctaaggaacagggtgtctgctcaacaagcccgggagaggaaaaaggtttacgtcaacgatctggaatcaagagccaaagaattggatgataggaattcaaagttggaagaaaagatctctacgcttgtcaatgaaaacgccatgcttcgaaaggttcttatgaacacaaggccaaaagtggacgaaagtattgagcaaaagcaaggatcagttaagtaagagcagataggcagttttaggtgactatattta

SEQ ID NO: 16340 - DNA, 535 bp, Malus x domestica
  Predicted polypeptide sequence is orthologous to G558, G578, G629, G1198, G1806
attgccccactggttctgataatgtcgcggactacatgggccaaatggcaattgctatgggaaagctggccacacttgagaatttccttcaccaggctgaccttttgagacagcaaactctgcaacaattgcatcggattctgaccactcgccaagcagctcgtgcccttcttgtcatcagtgactacttctctcgcctccgagcactcagttctttatggcaagcgcgtcctagggactaatgttgttcactatcagctcgaccgccccaccttaggacctacaaaaaagttaggtatttccccccttattagtaaaccagctctagtgctgagaccatgaagatggttaaccatcaaaattgcagattcgggcttttcggacccccttttttttttccttatgatgcttttcgaaacgtcgaggattaggaaaggtcgactggtgattacctagcatgtaattaaggtaaaagaatatgtcctctttagcataaatggatggatgtatactcaaaaaaaaaaaaaaaaaatcg

SEQ ID NO: 16341 - DNA, 489 bp, Malus x domestica
  Predicted polypeptide sequence is orthologous to G558, G578, G629, G1198, G1806
gctcaccaatcttgaaggcttcgttcgccaggctgataatttgagacaacaaacccttcatcagttacgtcggatattgacagttcgtcaggcagcgagatgctttcttgtaatcggagagtactatggacgattaagagcacttagttctctttgggcatgtcgaccgcgagagaccatgataaacgatgataactcgtgccaaacgacaacagacctgcaaatggtacaaccttcacagaatcatttctcatccttttgatcaaaccccattagccagcagagagctactttttagaagaagtccttgatccattattgccggtgctggatgcttctagcttgattaagctactttagaagagataggacatactaattttttctttcttattttctattttctactttttatgtcttcatgtaactacgttatcttgtaaatgcaattcaatattttctgtgcaaaaaaaaaaaaaaaaaatgcgt

SEQ ID NO: 16342 - DNA, 703 bp, Malus x domestica
  Predicted polypeptide sequence is orthologous to G558, G578, G629, G1198, G1806
cacgaggggattggtggcttccgctcatctgagctccttaagcttctggtgaatcaattggaaccattaacggagcagcaactggtgggtatttacaacctgcagcaatcatcccagcaggctgaagatgctctgtcacaagggatggaggcattgcagcagtccctggctgagaccttggccagtggctcacctgcgccatcagggtcatcggggaatgttgcaaactatatgggtcaaatggccatggccatgggaaagctaggaactcttgaaggtttcctccaccaggctgataatcttcgacaacaaactttacaacaaatgcatcgtatactgactactcgacaatcagctcgtgcgcttctcgcaataaatgattatttttcgcgtcttcgagccctcagttctctttggcttgccaggcctagggagtgacatgcattagattcctctccctgaagttcatccttaaagctagctagtcccggaacataaattagcaccatgaagccgagggccatacgatatatatgatggactttagccgtttggacatcaatatccttcaagggtgtgattaaggtgcgtgaagtcagattaacgttcatagtcaccatcaaagttgtcggttgttgtcacgcatgtttgcgtagatgtattctatgttcagaactgtagtatgaataatctgacgatgtta

SEQ ID NO: 16343 - DNA, 719 bp, Malus x domestica
  misc_feature (639)..(639): n is a, c, g, or t
  misc_feature (682)..(683): n is a, c, g, or t
  misc_feature (693)..(693): n is a, c, g, or t
  misc_feature (700)..(700): n is a, c, g, or t
  misc_feature (705)..(708): n is a, c, g, or t
  misc_feature (714)..(718): n is a, c, g, or t
  Predicted polypeptide sequence is orthologous to G559
actgctgagaacagtgaactgaaactgcgtttacaaacaatggagcaacaggttcacttgcaagatgcattgaacgatgcactgaaagaagaaattcagcatctgaaagttatgactggccaagctacgccaaatggtggacctatgatgaactacgcttcttttggcggggcaggtcagcagcagttctatccaaacaatcaagccatgcacactcttctaactgcacagcagtttcaacagctccagattcattctcagaagcagcagcaccagtttcagcagcatcagctccatcaactccagcagcaacagatgcagcagcatcatcagcatcagcaacagcaacagcagcagcaacaacaaagtggggagatgaaaataggaggatccgtgccttcgccaagccagaaagataatacatcagaggtcaaccaatctgtaacgaaggattgaaatgttatcgggtctgccaaaaattaaagacggttgaggcattgttcaaaaattgtagttgcacagccgcctccggttagggtacttaccctcccttcccttcctcccccttctgtttttgagtctggttagatacacctagacgacaccctttgttgtagcctgttctgtacatatcgtttnaagtgtaaatcgaatgatggggttaatttttcggtgaataccnnatgggtgtancccttgngattnnnngtttgnnnnng

SEQ ID NO: 16344 - DNA, 535 bp, Malus x domestica
  Predicted polypeptide sequence is orthologous to G584
tttttttttttttcacaaacgagtcaaatggcatttcgtaatacaaatgaatcaaatgcggcaaaggtgaagtttctgtccaacaatctctaggtttgcccaagactctggttataacttataatacaaaggggaaggaaaaaaaaaaccaatacggtgacggcctgtgcaaatttccataaccagaatgtgataagataacaaaattcggcagtcctgactaagtaataactatatatgtaacaactggagaagagaaaaaaaattaatgacagaatacatgacgaccttggcctggcctgagagttcatacaaccaatctccccaataaattatgatcgagtaaggatcgggattgcaatgtgtacctgaactggcacaagtccaaatattgagcaccaatgtcacggctttaggcagtgcgtcgaggatgctttccaagagttagatatctacacagaaaaacttgtctgcagtggctatcagagcagattcagttaaaagaactgcttccaggaccccagggggctttcca

SEQ ID NO: 16345 - DNA, 628 bp, Malus x domestica
  Predicted polypeptide sequence is orthologous to G584, G1136
ctctggatctttggtgtggctgactggaagccatgagcttcaattctacaactgcgaaagagcaaaagaagcacaaatgcatgggattcaaaccctagtctgcatcccaacccccaccggagttctcgagctgggctcttcagatttgatccgagaaaataggaacctggttcagcaaaccgaatccttattcggctcggatgtcgtttggggccaacccgaccctggaaccagatcccccatcgatataatcaaccgaaacttctccttcgccgacattggcatcatcgccggcgtaggggaagaagacgacaaaaaggaagttgccttggacataacggcgatgaagaagaagtgcggaaaagcatgtccggatcttgtccagttgtcgaatttgaatagccttaacccggaacattcggattcggagtttccgaaacggacgccgaaaaagcgagggcgaaaaccggggctggggagagacacaccgttgaaccatgtggaagcggagaggcagcggcgggagaagctcaaccaccggttctacgccctgcgagcggtggtgccgaacgtgtcgagaatggacaaggcgtcgctgctgtccgatgccgtttcgtacatcaacgag

SEQ ID NO: 16346 - DNA, 473 bp, Malus x domestica
  Predicted polypeptide sequence is orthologous to G584
gacaatgtcacggacagtatgggggctcccaacccccactcatagcagcagacaaataagctccatatctggtgttggagagccatcacagcttcgaaagaaaaggcgtgcacctgaacctactaggtccatgaaccactccggccaaaattcaggacggcgtagtggagtcaccgactgaggacaaggtgatatagcagttaattcctcaggacaaggtcattgaagtaaatcaagaaaattgaagatgagagaattgacctccccatcagtaaggttttatttcttctaagtagattgcgcgaaaaggggtcttggtggaggatgatgtattcagtactctgtgttgttctcgggtttgggcggacacttgaagcagtattacaaagtttgcttcaatttttgtgctgcccaggcttcttgttatatatagtttgtagttcaatctctaaaaaaaaaaaaaaaaaatcgtg

SEQ ID NO: 16347 - DNA, 418 bp, Malus x domestica
  Predicted polypeptide sequence is orthologous to G584, G1136
cgagttcagtgtccggactgcgattaccctaatgctagattgatgaatgcactcaaagacctggagttacaagtttatcatgcaagcatatcaagtgttaaagggttgatgcttcaagatgttgtagcgagagtgcctcagggtttcacaagtgaggaggccctgagaattgctattataaatagatggtacaactagaagttacaattcaataattagtttcccttgctaatgaggaatgattttgggtattggtgacgaactcattcttttttccttgttatagttgtaactcaaaattgaagatgtgtccgccaagttttaggagggaaatatgcgtaaattagttatgtattggattgttttccaagtccctaaatgttggttcttcttgcaaaaaaaaaaaaaaaaaatgctg

SEQ ID NO: 16348 - DNA, 649 bp, Malus x domestica
  Predicted polypeptide sequence is orthologous to G584, G1136
agattctacgcgctccgagcagtagtcccaaacgtatcgaaaatggacaaagcgtcgctgctcggagacgccatatcctacatcaacgagctcaaggtgaagctgcagacggtagagacggataaagaggagttgcagaagcaattggagtcgatgaacaaggacttgcccagcaaagattcgaggtcgtcgggttcgaccgtgtcagagcacgaaatgaaagggtctagcagtaaattgttagacatggacattgacgtgaagataatcggaagggacgccatgattcgaattcagtgttgcaagaagaaccacccggccgcgaggctaatggcggctctcaaggagctcgacttggaagtacaccacgccagcgtttctgtagtcaacgatttgatgatccaacaagccaccgtgaaagcgggtagccggatttacacgcaggatcagctccggttagctctacattccaaagttggcgatgcccgccagatttgacagtccatccggtaacattatcctatgcgatccgatccgatccgatccaattggtggtttagagcgatgggacattttaaggctcccagaaatgcagagagctctgctctgtagtctgtaatatagttattctacgacgtcgtacgtcgtc

SEQ ID NO: 16349 - DNA, 741 bp, Malus x domestica
  Predicted polypeptide sequence is orthologous to G590
atttgttggtgctgcaaaggtcctccctgcagatttcctttcatatggaaaataatgtaaaaaggttaatatcgtttgcttagttcagtatgcattatttacacagcgataatttacctgagatgaggctggcagttgaaagggtctcaagtgagtctgaattgacggttccaacccaaacgacgtctctgaattaactacatttgacatgtctggtacatatgactcgtttgcagcggtgcattggttggataaattgaacaaatttgtcatgtccaaatgcagaggcctaatttccttaccaagctccattctcatttgcgagagctgtacaggttgcagcgttccaggtaggcacaaagaatgtagactcataccatttctcattgataacatctgaagtaaaaatcacaaagtaaatcaatcaaaaccaagttcttgattttcatcagtgctaggcaagtttcaaccagaaccataagattcttcaaacagtgcacaaaccgcagtcactgttgcaaagctaaaagctgacctatttcattcaacattagggctcctcatcgggttcaaggctgacaaaagctaaccatagaagaataaaagatcttaaatgttatctgagaacagacttatcataagagtgagactgctaaaactttgattttagtctgaccacgtcattgaatcacatctaccaattgttatctcgtagagggtcaaattcaattattcctcgcc

SEQ ID NO: 16350 - DNA, 564 bp, Malus x domestica
  Predicted polypeptide sequence is orthologous to G600
atgaaggatgggcgccatatgttgtctggagaagaagggattgcctcttcaccaaggttcaagtcaaaacgacgatcggatgggccagacattttcaaaagtgttgaaagaaagaagagatcggacaaatcaagatcttagaagtgcaagaagggagtttctacaagcgaaaattcaagtgtgctttgaaacgaactgtgtgcctctataaaatcaagcactcgacgggatttcagagatcgaaaaggcgagctcagaattcgaagaggccaattcaaaaatcgaaaaggtgctagctttctcaaaagctgggctcgctcggaaaccacgggccaatcttcctttccagacgcgtcaacacccatcacacgcaaactcagctttgcggaaatcacgggtaatttgtcgaagcgccgatcccagatatcgaagaggcgccaatctttttcagcttcgtcaacacctgtcacatgcacactcagcttggcggaaattacggacaatttgtcgaatatttctgataaagaagaaagcgcgtgaagccatactgatcaatcacgcatt

SEQ ID NO: 16351 - DNA, 651 bp, Malus x domestica
  Predicted polypeptide sequence is orthologous to G600, G2768
cgaattccgttgctgtcgaagaaaaggaaaaagaagaaaattcgtgtgcctgtgaatgacatgcaatggagaaaccctcaagatcttgcagccgaaaactatatgatgcctatgggccccgctgcttataatccatactggaatggcatgcaacctggcatgggcatggaaggatatatgacatcgtatggtggtccgatgccatatatgggttatggtcccattgacatgccatttgggggtcttggtccacaggacccatttggtgctcaaggttatatgatgcccatggttccgcctcagagggatcctgcggactttggtatgggcatgaatgggatgaatgggatgaatgggatgaatggactccccatcatgagcaaagaagaatttgaggctcggaaagctgatttgagaaggaagcgtgaaaatgaaagacagggtcaaagccgggagttctccaaagacagggaatacagaagggaagttagcagcggcggcgatggtcctccaatgaaatccaaatctaagtcgttggcccgatcaccaagcccagactatcctaatcagcaccgccgtcaccgacgcgagaagcaatctccagaacgcaggccctcacgtgacccacgtgaccttgagccacagccgcct

SEQ ID NO: 16352 - DNA, 715 bp, Malus x domestica
  misc_feature (691)..(691): n is a, c, g, or t
  Predicted polypeptide sequence is orthologous to G602
gcaacgatggaggagcagcggaggaaggaggaggcagaaccgtctctgccggtggagcggcctctagaggttgagcctccgctggcttcggcccctagcgacgtcgcggttgaggagaaggcggctgtggttccgcggagtgatgtggatgttaagggcggtgatgatgtcaaggctctcgccgtagttaacaaggttccggaaactctggtgaaaaaggcatcaggaggatcaattgacagagatatagcacttgcaggactggagaaagaaaagagtatgtcttttatcagggcatgggaagaaagtgaaaaaactaaggcagagaacaaggcccaaaagaagctttctgatgttactgcatgggaaagcagcaggaaagcagctgtggaagccaaactcagaagcatcgaggaacaattggagaagaaaaaggcacagtatgcagaaaaaatgaaaaacaaggttgccttacttcagaaacaagcagatgaaaagagagcaatggttttagcccagaaaggggaagaacttctcaaggctgaagagaccgctgctaagtaccgtgcgaccggaagcattccaaagaagttcctcggttgcttttgaagtagtgctttgaaccggtttgaaaacaatctatgtaacttctgggttttgtcatgtgtatatctttcttgtttgctctttntgcattttggggttcgagttgatt

SEQ ID NO: 16353 - DNA, 573 bp, Malus x domestica
  Predicted polypeptide sequence is orthologous to G602
aacatgacagaggcagaggaacccaagttgctagaacccgagtcaccctcagatcctccacctcctccgactccggctccggtggaggaagagaagccggttgtggaagctccaaaagatcctgagtcccacaaggacaaatctgaaattctaccaccacctcctgaaaacagggctgagcctgatgagtccaaagctcttgctattgttgagaagccttctgaacctgctgcagaagagaaaagcaaggagtattccgtcgatcgtgatgctgtgctagcaagagttgcaacagaaaaaaagctgtcacttatcagagcatgggaagaaagtgaaaaatcaaaggcagagaataaagctcacaagaaactatctgccatcggttcatgggaaaacaccaagaaggcaactgtggaggctgagctgaaaaagatcgaggaacaattggagaaaaagaaggccgagtatgtggaacagatgaagaacaagatagctttaatccacaaggctgcggaagaaaagagggcggtgattgaagctaaccgcggggaagatcttctcaaggcggaggaa

SEQ ID NO: 16354 - DNA, 607 bp, Malus x domestica
  Predicted polypeptide sequence is orthologous to G602
tattgaagaaataatgggagcaacgatggaagagcagctgaagaaggcggaggccgagccgtctctgccggtggagccgcccccggcttcggcccctgtcgacgttgccgttgagaagaaggcggatgtggttccgccgagtgatgtggatgtcaagagtggcgatgataccaaggctctcaccgtagttgacaaggttccagaaactctggagaaaaaggcttcaggaggatcaattgacagagatatagcacttgcacaactggagaaagaaaagagtatgtcttttatcagggcatgggaagaaagtgaaaaggctaaggcagagaacaaggcccaaaagaaactttctgatgttactgcatgggaaagcagcaggaaagcagctgtggaagccaaactcagaagcattgaggaacaattggagaagaaaaaggcacaatatgcagagaaaatgcaaaacaaagttgccttacttcacaaacaagcagatgaaaagagggcaatggttctagcccagaaaggcgaagaacttcttaaggctgatgagactgcggctaagtaccgtgcaactggaagcattccaaagaagttcctcggttgtttt

SEQ ID NO: 16355 - DNA, 551 bp, Malus x domestica
  misc_feature (436)..(436): n is a, c, g, or t
  misc_feature (445)..(445): n is a, c, g, or t
  Predicted polypeptide sequence is orthologous to G605, G1944
gcgtttctttggcaagtccagatgggcgtgttgtaggtggtggagtggctggtctgttagtagctgcaagtcctgtgcaggttgtagttggcagttttctatcgggaaaccagcatgagcagaagcccaagaagcagaaacacgattacatctctaatgcaacaccaactatggctgttcctatttcgagcgctgaaccaaaaccaaacttctcatcctcaacttctttccgtggagataattggtcttcactgccatcagattcaaaaaacaagactgacattaatgtatcgttgccaggaggcgtaatgtgaagagtgtgcttttaattgcaatatgaggtttgtcactgaccacattggcaattaagctccctagtcccaactgttggatctctcacctgtacttgtttgtctgtaaacttgttgactgctangtatcgtcntgggggtttcccccgtttgaggtgttatttaatttagccacgtaggtagtaatctagcgctgcttcggtagcctgttgtgacatctagagtagtttgatcgtgtaa

SEQ ID NO: 16356 - DNA, 630 bp, Malus x domestica
  Predicted polypeptide sequence is orthologous to G616
tttttttaaaggagaaaagaaaataacttcaatcgaattgtcagttgcatcttctccaacacagacaatgctgttgcacacagacaaataaaaatatatatccgaaaataaagaaatggaaaatggttaaaagcagaaataccaacaattccagaaggattataatatttagttatcatccgatatgcagagagaggcacatgaattccctcgcagcttcccattgcttgttttaacttcacctttccagaaagaagcttagatgggctatcaagtactgatcgttgaaaaagatcagttctttgctttgcccttgtggtctgaatgccgggttccgtcaccgtagagctgctgcaagcggcgatcaaatccaccagggaattgctgctggtgctgctgatgatggtggtggtggtgattctccatggttggagaagccgcagccgcggcagctccgatgaagaagggtacattggacgttccgtctatgggagaaaacctctgaaggtgatgaggcataagagacggtgaagaggaagaattggactgaagggtccccctattgaaaccagcaaggccgccggaagaagagatcgaaaagttcaggttgtagtcaacgccactgcccgg

SEQ ID NO: 16357 - DNA, 542 bp, Malus x domestica
  Predicted polypeptide sequence is orthologous to G616
agaaaagaaagtcccaaaattgaatgagtctttgtatgagaaaggcatgaaactactgctatggaggtggaggagatacaagccagcaacaagttcccaagaatcggaaatggcagcagcagagatcacaagccatcacccgaagacgacgacaatcaagacccatcatgcctagaggtcaagagggacgccgccaccacagccgcagccgatgcgggcaaccgtctccgcggttggcaccattcccgcatcatccgcgtttccagagcctccggcggcaaagatcggcacagcaaggtctggacttcaaaagggttgagagaccggagggtccggttgtctgtaaccaccgccatagagttatacgatctccaagatcggttgaattacgaccagcccagcaaagcaattgagtggctgatcaaagccgccgccgatgccatcgctgagctcccttctctgaacaattcttcgttccccgacacgcctaagcagctcagcgacgagaagagggcgagctgcgagcgtggagggtttgattc

SEQ ID NO: 16358 - DNA, 617 bp, Malus x domestica
  Predicted polypeptide sequence is orthologous to G618
tatgcgcctttaatttagagggtgggcatccattttttttttttatttatccaatggagaatctttcaatcaaaataagagaacaaagaaacccctcaaaaattaaagttaggataaagaagtttccgtaagaactagcgctagacttcttcccccctttctacttttcctctctccctttggttgggcttctacccgggcttttcattctgttttatagagacccgaggaaataaaaaagaatttgtagaaggctgaggcactttccccggcgtacggaaacaaaaatccaggatgacggctttcaaaaaacgagtaagggacggggaggccctcgaaaccaaacgagactaaaagggacatgggaattagcaccattcctatgatttgtctcgaaaagccaacgagcagccctctctctatctcggtctcgatttagcatcatatatcaatctggagaacatttttattggttgtagtgcggattaaggagccgctcccccatgctgcggctgcggaggtggggggctgccgcctcccttggttttttgggggaagtatcccaattcttttttacgggcctgccgaatcctgaaaaagggttcttggggaagcgt

SEQ ID NO: 16359 - DNA, 450 bp, Malus x domestica
  Predicted polypeptide sequence is orthologous to G618
tccgcaaaagttgagagagagggcaacggcagcggggattggaaatggaggacgaagctgataagtcagcttatatagctccaggtgttagggttttcacacgagtgttcctgcacgtgcaaggttcagcgcctcacgctgttccaccaggtcacgggttcaaattcggcccgcagcactcttgggtttttattccaggtcacgagttctatcccaccgcctggcacttttgtaccttactatggtaggcgggtaacagcggttatttatccataaccgtttaatctcttacccgcataaccgtttaccctttgagtaattacataaatgattaaagccattattttgtttccagcccctttccccaattccaggtaggggatgggcaatacttatagtcggcgggtaacagcgggtatttacccataccatttaatctcttacccccat

SEQ ID NO: 16360 - DNA, 656 bp, Malus x domestica
  misc_feature (628)..(628): n is a, c, g, or t
  Predicted polypeptide sequence is orthologous to G618, G2057
ctcgactttcctcccaccgtcgctcgactcggacgccattgcagacaccataaagtcctttttcccaacgggtgcttccgcaatcgcagccgcagccgaggctccgtcgtcgacgatacagtttcatcagaactacccacctgatttactctccagaaccagcagccagagccaagatctgcgcctctctctgcaatccttccaagacccaattctcctccaccagcaccacgctcagacccatcaaaacgagcaatcccttttctccggatcccaaaacccgcttgggtttgatgggtcctccgccgcgtgggcagagcatcaccacaaccagcagcagcaagagatgaacagattccagagaatggtggcttggaacagcggaggcggagatagcggtgataacggcggtggatcatcgtcgtcaggcgggtttacattcaactcgctgctaccaacacagcagagtggtactagttctttgcagcagcagcagccgtcgttgttcggccaaagccagttcttttttcagaggggaccccttcagtccagtaactcgccgtcaatccgtgcttggatgatggaccagcaaaaccaacaatccatttctcacgatcatcatcatcanatctcgcaatccattcatcaccaaccgt

SEQ ID NO: 16361 - DNA, 681 bp, Malus x domestica
  Predicted polypeptide sequence is orthologous to G618, G2057
ccaaagtcagttcttttctcagaggggaccccttcagtccagtaactcgccgtcagttcgtgcttggatggtggaccagcaaaaccaacaatccatttctcacgaccatcatcatcaaatctcgcaatccattcatcaccaacagtccatttccggcatgggattcgcctccggaggcggattctccgggttccacatcccggcacgaattcacggcgaggaggagcacgacggtacttccgacaagccgtcctctgcttcctccaattctcgccattgaaccaaagaaatggactgaacttctcttcaaaagggctcaagctctcatctcatctctgccttccacagagagattacaagagctacctgttggtttccaattcatatatggccaggagacgatttttcggtcgctttgttcaatggcgtgcgccttgggaagaagaaatctgagtgcattttcgggtttttatcgatccctcggttcgttttagcttttatttcatcagtttgttgcttcttgttttagaagttctgttttcacgtttgagatgagctctcaaagctcaaactttttgcttgttctatgttggatttgtgtttctgttgctagactagcagtatgttgctaaatttgacttgtttcattcctagagttaaaaaaaaaaaaaaaaaatcggt

SEQ ID NO: 16362 - DNA, 527 bp, Malus x domestica
  Predicted polypeptide sequence is orthologous to G630
ttttttttttttgattgtaaatctttttatttaaaattaaatataaacaatgcctgatgaaaactgaccacacgatgtatgataaacagatgctattagaggattcccaaaatcctcataaagaaaatccggagaggatactcattcaatatacatggccctttagtgagctgtaaacagccggacttaaccggagaaggctcgatgtcgaacagactagaggtaagaactttctgcagaatgtttactgtttaagacggagacggggagaccacatacagtagcaggtttctcttgtttgtcaccgttttgaggtgtcctacttttattccagttatgtaaaaaccaaaaacaactattacaacggcacagagtccacagtcaacgacaatctcctagaaattctatacaagacggcctccgaacggacgttggagttgactgtatcatcccacattccttcccgacgaaactcaaaggtatggtatgcacacaaaactgggtttggtcctcacaagcctcgtgcc

SEQ ID NO: 16363 - DNA, 610 bp, Malus x domestica
  Predicted polypeptide sequence is orthologous to G643
tcgatccctccgaaacgactgccagtcctgggtaagtcgattcgacactcaccgccgcccaatttccaaaaaaaagatggcattttgagcacaaatttcgaaaatgaaacccgaacagaccccgtcccagctcgaccgatctcaccgttcttccggcaaccggcgcagcacgcgttcgcaagcagcaccggactggaatccgactgacgagctcatcctcgtgaacgaggtcgccgccgtagagggcgactgcctgaaagcgctgtcgtcgtttcagaaatggaagatcatagctcagaactgctttgctctgggcgtgtcgcggactttggaccagtatcgccggaagtgggaggctttgttcggcgagtacaaggggatcaagcagtgggaggcgaagtcccgagcttccgattcgtactgggttttaggaattgaaagaaggaagcggaatgggctgccggagaattttgaccaggagttgtttagagggattgagaagctcgtgagagtgagggggaaccaatcggatacagacccagatagtgatccggaggatgaggcggaagaagagcctgatgttgattcagaaccaagaaaaaggcgtcga

SEQ ID NO: 16364 - DNA, 419 bp, Malus x domestica
  Predicted polypeptide sequence is orthologous to G652, G1335
gaatttctagggttagggttttgagatttgcgattgagagagaaagatgagtgagagactgagcggcaccgtcaagtggttcaatgaccagaaggggttcggcttcataacccccaacgacggtggcgaggatctgtttgtacaccagtcctccatccgatccgaaggtttccgcactctcggagacggcgagacggtcgagtacaccatcgaggaggatgccggtggccgaaccaaggctgtcgacgtgactggcccagaggagggtcccgtacagggtacccgtggtggcgggggtggtggtcgaggccgcggaggcggtggcggaggctacggctttaacggtggttctggtggacgtaacggtgggggtagaggtggccgcggaaccggcgggtaccgaggtggaagctacggat

SEQ ID NO: 16365 - DNA, 426 bp, Malus x domestica
  Predicted polypeptide sequence is orthologous to G652, G1335
cttcataacccccaacgacggcggcgaggatctgttcgttcaccagtcctcgatccgatccgaaggtttccgcactttgggagacggcgagacggtcgagtacaccgtcgaggaggatgccggtggccgaaccaaggctgttgacgtgactggcccagaggaggggcccgttcagggcagccgaggcggcgggggtggtggacgaggccgtggaggcggcggcggcggaggctacggttttaacggtggctctggaggacgtagcggtggcggtagaggtggccgaggaggcggtgggtatggcggaggaggctacggctcgggtggtggtggctacagctcaggcggtggatacggaggtggaggcggtggtggtggtgcttgcttcaagtgtggcgagtctggacacatggcgagggactgctc

SEQ ID NO: 16366 - DNA, 473 bp, Malus x domestica
  Predicted polypeptide sequence is orthologous to G652, G1335
ggcggtggaggcggctatggaggaggcggccgtagcggtggtggaggcggaggtgcttctggagggtgctaccagtgcggtgagtcgggccatttcgctcgggagtgcccgaacaggggttaaagcagtcgtttccaattcagcgtctctctgcctgtgggtggtgctggtgtgtttggtttttgcttaattaagtcttggtttctatgaatcaaaaactcgtttcgagtagtcgtggtttgcggttttatggatcatctcttttgatttcaatctatggaaacatgaagtaaacgatgattccttttgatgtagtaatttttctttctttctttttggttaaggtttttttagtgaggatttggtgttaatctggcagaaaatgtggatctgtggttagtggttggatgttgattcatacacattaatatactctgctcctccttaatgaaaaaaaaaaaaaaaaaattggt

SEQ ID NO: 16367 - DNA, 446 bp, Malus x domestica
  Predicted polypeptide sequence is orthologous to G652, G1335
tggccgtggcagtggtggaggcggtggctgctacaagtgtggacagtctggccatttcgcaagggagtgcccgaacagtggttaaaccagcaacttcacccttactgtcctctcctgcttctggtctgttagtttttgcttaatttagtctggtctttctatgaatcaaacagtactcttttaaggaatcttggatgttggttttgtgggtcatctctgttgcttccaatctgtcgaaacatgaatcgatgacgatgtcttttgatgatttaatttcacttttttcttcttcttattttcaagttattggtgaggatttagtattttggcagaaaaatgtgaatctctgctcctcattgaaaagtttctatgtctgtttgacaagtcttgtctcccactcttattcttaacaaatgtgctttcaaaaaaaaaaaaaaaaaatgctg

SEQ ID NO: 16368 - DNA, 714 bp, Malus x domestica
  Predicted polypeptide sequence is orthologous to G653
ccatatccatccgcttgccatcacactccttccgtacggaaaaggacccatttgcccttcctcacccatttcgttttcaaaatcttttcttttttattttaccctttttaattatcgagatttttgagcttcactcagtcagccttaaagcttcaaagggtggaaggttgagagggggtgatcttggtaaaaagagaagaatcagatctagaaggagatagaaatatgtctttcattggcacccagcagaaatgcaaggcttgtgaaaagacagtttacccagtggaggagctatctgctgatgggatttcctaccacaagtcttgcttcaaatgcacccactgcaaagggactttgaagctgagcaattattcctcaatggaaggtgttctatactgtaagcctcactttgagcaacttttcaaggagactggcaatttcaacaagaactttcagtcacctgcaaagtcagctgagaagttaactccagagctgactaggtctcctagcaaagctgctagcatgttttctggaacacaagacaaatgtgctacttgtggtaaaaccgcttatccgctggagaaggtgactgtggagagccaggcctatcacaagtcgtgtttcaagtgttctcacggcggctgtcctattactccctcaaactacgcggctttggagggcattctatactgcaagcaccatttctcccagctt

SEQ ID NO: 16369 - DNA, 692 bp, Malus x domestica
  Predicted polypeptide sequence is orthologous to G663
tgtgattggtgtagatggtctctaatagcagggagaattccagggcgaacaaaagatgaaatcgagaattactggcacagtaatttatgtaagaaacagcatgaggatcatatattatcatgtagaccctccgcctccactgagatcgcagacacagtacaacagtcaaaagttgaagtgcaattagaaaatgaccccagttgcaataataattttgcattggggtcctccatgccttgtaatttaactgacatcatggcagaagagtctgaaacaagtagtgggtcattactgtcagcatcaaagtcgagggaagaagatcgttccagctgctgggaaaatattttgatggaagacttccacacgagggagatgagcctctctgagtttctggatactgactttacaaagctaagcaatgtgtttgggtttgggatgtgtgatgtcatgagcaatgaggtgttacttgaaggagaatctggctatggattctgacgatggatcttagatgcatggctgcttaatttcactgacttaaaggaataatggatgattatgtgctaaataacaaatatgtatttgccaaatggcattgtcgaaatcctgcgtattatataacactgaataaattagttgcctagggttttgcttcagacttgtgctatgcgctttagaaaataaaaaatgcaagg

SEQ ID NO: 16370 - DNA, 543 bp, Malus x domestica
  Predicted polypeptide sequence is orthologous to G669
gttaaactatctgagaccagacataaagagaggcaacatttcaggtgatgaagaggaactcattgttagactccataaccttcttggtaacagatggtcgttgatagccggaaggctaccggggcgaacagacaatgaaatcaagaattactggaacacaactttgtggaagaaatcgaaagccgattctccttctggatcctcgaaagaaacttctcaacatccaagcaaatccgtagtgaaaaagaaagatgtcgagtccaaaacaacatcaactgcagctgctaaacctctagtaataagaaccaaggccactaggttgtccaaaattctagtcccacaaaacattcctagtcaaggacggagctagaaatatttttgactgggggcgtcctaaaacaaccaagtaaaataatgggtgttaagttgttgagggtcatgtacaatgaaaaatctctaaattaaaaagttagaatttaaattgtaattccacaaacgaatggatgaagtaaattcatataaaaaaaaaaaaaaaaaatcgtg

SEQ ID NO: 16371 - DNA, 634 bp, Malus x domestica
  Predicted polypeptide sequence is orthologous to G675
tgatccagatgggttttgatccaatgacccatcagccaagaactgacctattttccaacttgtctcagcttagccctagctaacctgcaggatctcatgcagcaatatcagccattagatcacattaatcaacatgatgcaacattacacgcagatcaagccgttcaattgaccaagcttcaatacattgagcatttactccaatccgtagcttatacaagcaacaatgacacttatacccagaacagaagcacagagatggaaatggatgatcaggcttttaatttgttaagctcgattaatattcctcctagcaaagaaaccccgaattttaattcactacaactggaaaatccaagctcattttctcatggatatggtggtaattcttctcaaccactccaccatcttcaacccctactgcctcatgacctagcagacccacaagtcgctttcagttctctaccatctttgaataacagtaaccatgaagtgggccagggctccaactttacagtggtccgtgttcaagaaaagaacccatccgatgaatcttcatggtttaataatcttgtatctcctaccgctccttctattcctccaaccagcaatgttcccggaaatgcgtactgca

SEQ ID NO: 16372 - DNA, 646 bp, Malus x domestica
  Predicted polypeptide sequence is orthologous to G715, G1646
cacgaggaaaatctaagaggtttgattaatatgaaatgacccacaatcattcgagttagcaacaagagataagatagcctaaattatacaagactgcacattcaacattaaacacagcagtgatcagctagtgattctccaactgctctggatcaatagttttaccaggtctatgtcatcctcacaagaaaaaaataataataatattaattcagcagttccaaaatcatctgccaaagctcaatatccttcctccgtgcccgccacgcaccaaatcatcagcaaattagtctcttcaactttgaccatcaaggttgccctgcccactgctccctccactcccgtacgacccatcatccgccgcagtctgccacaccgactgccacgcctgcgacggaggctgcacgccgtaaaccccagtggggtccaccgcaggcctcccaatcatcatccccccggggccaccagccggctgacccatcggcggatagaaatatggcacaccactcgccgtcgccccgaccatacctccgagacccaccgcctcctccttgatctcgtcgcggggcacaatatccaccaagaaatcgaatatgtcggtgcgggtaatggcggcggcaatgtcgtttttctggagagtccggcg

SEQ ID NO: 16373 - DNA, 581 bp, Malus x domestica
  Predicted polypeptide sequence is orthologous to G718
gctcccttcaactctccttcctctcttcctctcttcctctctccaacctgccaagtccatggttgtaacatggatcttacttttttaaaggattaccacaggaggagtagggtttgtgatgaatttatttgacaatcctcattttttccctttccaaatcttacgcctcttgtctctctactcctcgtctgatagactctctatggactctcacctataacaacaacttcttcactcctttctaatattcctttctttctccataaactttcgatctctgcttttcaaatacaagccaaatagttttttactctagattcatatggaggtcgcaccagacatccatctttgttcctccggatttctttaataacaggtgctcgtggccggatgttacaatcggcgaggcgtcggttggttggtggcgagggtttgtgctagtagggatgctcggcggcgggtgctgcagtagaagcctaggttttcttttgttgtattttatgacttgggcctttactgtttgttggaactattgggctagtatggcagggtcctcttttgggctagtttactaaaaaaaa

SEQ ID NO: 16374 - DNA, 713 bp, Malus x domestica
  Predicted polypeptide sequence is orthologous to G718
caggaggtactgccagagagctaaattttcccaacagtggaagtccaggctcgataaatgtgctttatcaggattccagtaggctgtcaccatctaaggccactgcggctgaggttcttaaccgaggtgctgaagaatctatgatctctttcaacctggatgcaacgccggatattcatcgtgctctctctcttctgtcaacgagtccttgggtctcaggcgaggggaaatctgttccacttgataccaatcaaagttatcataacaactcacctcaacaggggatgcatgcgatgactcaaggtgtgccggcctcttcagagtactggcaaactcagcatccacccctagatacccaagcacacgtctcccactcacacagtaatgttggcaaccaatttcagtatcttcatcagttcaaagcgccgtatgcgtttggctataatccaaaccaattcagttgactccacctggagtactgttctttcacccgcataacttatcatgttaagaaactcggcactgctttggttttttacggacgaaattccggggattaggcattatattatcggttgcgaatgcaggagctgtgtatgtgtttaatctggtgctatcatatctcctttgttatggcatgtataatttgacaatttgtagcaaattggttcactgttacattgctttacacatgcattttcttttattaaaaa

SEQ ID NO: 16375 - DNA, 462 bp, Malus x domestica
  Predicted polypeptide sequence is orthologous to G718
tttggaatgggaacggacgattaatgccagcaaaagcttttccttctttaataccccaaaagcaatctcctctgcaacctccccaaatcaccatcatctggtgactgggtgcttttgcgttatttgaagacacgattttggagtagttttatgaattcggtgctgatgatggagtggaatgaaaaacctccttcactgtgggatttggagaaccttttcatgtatggtgcaaaagttactgaaaatcctaagaagttgcaaccagcagactggggaattgaaggggaacgaggaatgaattctgaatctttctattcgattgggggtgatgggggtagtggggtttctggctctgatttgggagatggttcatctctcacttcgaaatcaacttctgtcaattcctcaaacgacgaacagtaaaattcccatttcaactttcaagcctttgaaaggattccc

SEQ ID NO: 16376 - DNA, 667 bp, Malus x domestica
  Predicted polypeptide sequence is orthologous to G720
tccttatagtcacaggcctatcatggccttccccccgtatcattacaccaatcccaccctatcaatgcctccagcctatccaatgtggggatcacaaccacctgccagcagtcatccggccactgtccagatgtggggccaacctggctatccccactcccagtggcaaccatcagatcaaagttggcagtactggaacccttatccagggttacaagctgatgcatggggttgcccagtaatgccacctgaacaaggtggctattccccctatcctcaaaacacatcaggttttcaaaatgcaggaggtcatgcagttgaaaactgccatggttacagcatgccacaaaactctttcgacattcatccggcagaagaagttgttgacaagattgtgaaggaggcaatgagcaagccatggctacccctccctctgggccttaagcctccttccactgaaggtgtactagctgagctaacaaggcaaggcatctgcaacattcctcagatcaacggctccaacacccgctgacgtcgcggaccttgtcccatccacaaggctagtgtggtggtcctcctctcacttcactcagccaaatcaagtcgagtccataaccatgtgttctgtcaaattttaacatgtattggacgcttgatttgtgaacga

SEQ ID NO: 16377 - DNA, 435 bp, Malus x domestica
  Predicted polypeptide sequence is orthologous to G728
atgtttttccccgcaactgttccggcatattacagagcacccgtctcaagcgagaagcagctgaaaaagactgaaggttgcgtaagctgatggtaccgcgttgttgggagaggattttccgatgggcaccgctcccggccattcctcatttgcagttgaggggaaggtgaatgcaaaaaaacagaaagatttgttgtagcaaccgcagatttttttttaggactcgttctttctatgtgttcatacctttattttttttcaagtacataatggaagattcaaaatccatgcatcatttcttgcacctgaggtccgaagtttgacttctccctccctcgatatttgcttgtatcgcaagaaaaaaatccataaaaataaacaacacttctaatggccaataaacgtgagtatgaaaaaaaaaaaaaaaaaatgcgt

SEQ ID NO: 16378 - DNA, 367 bp, Malus x domestica
  Predicted polypeptide sequence is orthologous to G730
acaaaatacccagaaatctctccaacacctgaaaatctctaaccctaatcagatcaccaaggaagctatctagctagctcacacaatacatatatacaaacacacagagttatttcccagcacaaggaagaagaaagtgctcataaatatacaggagggaattgtaaagtagctagatatatctgtatagggtttaggagaaggagattaagagagggaggtggtttgatggagttgttccctgcacaaccggacttatctctactaattagccctccaaacagcaaaccctcgtcctcctcctcatcaactagttggaggagaagcagtcatcaacgtcatcaggagggggtggatttggggtttt

SEQ ID NO: 16379 - DNA, 593 bp, Malus x domestica
  Predicted polypeptide sequence is orthologous to G732
cctaagatatacctagattatatatattcgtgtataattatcgaataatttagtatttaatctaagtttttatataaatcttcatatatttctatggcttcttcaagcggaaattcctctggttccgctcagcttcagaactatgcctctgaaggggatctgcatcgtccggtggatcaaagaaagagaaaacggatgcaatcgaaccgcgaatcggcgcggcggtcgcggatgcggaagcagcagcacctggacgatctgatggcgcaggtcgcccagctgcggagggagaacaaccaaatcctgaccagcataaacatcaccacccagcacttcatgaatgtcgaatcggaaaactcggtattgaaagcgcagatgggggagctcagccagagactggagtccctcgacgagatcctcggttacatcaacggcggcgtcggccacggcggaggccttgaaaccacccctgttgccgatcagaacagtttcataaacccttggaatatgcttcatgtgaaccaaccaatcatggccactgctgacatgcttcaccaatactattaattaatccatggccacgatgacaacag

SEQ ID NO: 16380 - DNA, 657 bp, Malus x domestica
  Predicted polypeptide sequence is orthologous to G732
cacgaggattaaataaattggcaacaaaaccagaagccaaaaggaaaacagaagtatcgcttacacatccttacatgttcaacagtaaaacaacaacccatgacctacccatcaatcattgtacgaacaaatttacaaaagccatggatgttctaagtagttaaaacttacacctcaattaatttcactaatctctcacttaatccatgattaacccgactgagtttagcacataaacatgtctgcagaggccatgattggttgattattcaaaaagccagtactccatgggttcagaaacccatcacctccaccaataatattatgattatcttcttcctcatagatccatttgcttgaattaatacaatccataatatcattgagagactgcaatctgtttgtgagctcatccatctgagctctgaggactgagttttctgcctcgagcttcatgtaaagctggttggtcacgttcatggatgtgatgatctggttgttatcccttgtcaggagaccaatctgagcagtcagatcagtcagatgctcctgttttcgcatccgggatcgacgtgccgattcccggttggacagcattcttttgcgctttctctggtccatgacttggttaagatcttcatcagaccctgagttttg

SEQ ID NO: 16381 - DNA, 582 bp, Malus x domestica
  Predicted polypeptide sequence is orthologous to G740
ctaaaggtgaaatctccaaactcgtgcaatctctctgagtctctctcgcacagacgaagccatgatccgggtacccagagacgacgccaagcgcggaggcggaggcggaggcagaggcagaggcagaggcagggccaattcgctcgcgcgatcagaatccgggcgggggaagaatccagcccagccagcggagctccgagatgagaagaaagaaacaaaagctgtcgaaagctctatgagtaaactccaacttgatgatgatactcctacttcaaagaagaaacgttaccgcgagtctaagaaatgccattctcagaatgagcattgtgcagtttgccttgtggacggccaccaccaacatctgtgtccctaccgggaaagtgtcccgttgggtgtaactaaagttggagagggctatatactaatgtgtaggacttgtggttttgtgggtaacgtctgccttcatggccgctcttatgctcgtccctataggcggtgttattggcgtctgaaacatgggtacccaatccacgaggaagtggagcaaatcagggcaagacagagagaaatggctgaaatgtc

SEQ ID NO: 16382 - DNA, 537 bp, Malus x domestica
  Predicted polypeptide sequence is orthologous to G744
ctctctcagtccctctctccttcgcatttatctccaacttttctctccctaatttaaaaaaaaaaaaatccgtgcaattaaattttccaattccattatttacagaaatggtattttcccaaatatttaatattttataatctctctgttccctgtactggattccgtacaaccggttctctgcagcagcagcagcaaaaagccccccactttcgaccaatccgccgccgttttgacccgctatggagagcgttcggcttcaaagagttggagtcgttcaacgtcttccgctcctcgtcgtcaacttagttgctggggctctggttttgctttttgctcttgctggatttttcacaggaggtattgctggtgctttagctgggaaggcttctgatagaggtgttgtacgtggagctggattgggtgctgttgctggggctgtgctctccgtcgagattttggaggcgtcgcgtgatctactgcggctaagccgccctggctggcggagatcttcattgatggtgagctattaagctc

SEQ ID NO: 16383 - DNA, 483 bp, Malus x domestica
  Predicted polypeptide sequence is orthologous to G744
gattcatgacctagggtttccaatccattaattacacataaatggtatcccaaatgtttaatctttattaatctctctgttacctgtacttgattctgtacaagcggttctctgcagcagcagcagcaaaaagcccccaactttcgagcaatccgacgccgtttttggccgttatggagagcggagagctccaaagggtcggagtcgttcaacgcgttccgctcctcatcgtcaacttcgttgctggggctctggttttgctttttgctcttgctggatttttcacaggaggtattgctggtgctttagccgggaaggcttctgatagtggtgttgtccgtggagctggattgggtgctgttgctggggccgtactgtccgttgagattttagaggcgtcgcgcgatttactgtgtcttggccggcctggcgctcggagatcttcattgatggcagaaattacagaggagcttatttgttgga

SEQ ID NO: 16384 - DNA, 635 bp, Malus x domestica
  Predicted polypeptide sequence is orthologous to G748, G1900
ccgattttttttttttttttttgaacaaaaagatctttgaatttcacatatatagagatatagacatgtacatgaacacgaactcaggaaaactaagtacatcagagctttatcctgtgcattacaaggaggcaaaaatagttgccactagagctttatcctacattagttcccctatcatactgaggaaccctagagagtagagacagcccctctgattccgcatcccggattcgaccggctcaactaaaatggcctttagctggatggggttctgccaaaactcgtggctacttgactagctagctacttcatgagctctcatgaaagttgagggatctagacaacgcagctggatttgctcgcaaagcgggagaggattcagaaacggttttctttttgtcactctttgactggaaagccttaaacaaccctccgccactgatggaatcgttcttgattccgagcgttgcccatattgaactctttggagcttcactcggatcatcaatccctaatgtttttggaacccaaaacaatccatttttctgtcgtgatggctcttcttaaccgcaaatttctggttttagaacgtcttcactccttgaaggcttccccaacgttggaaaatttga

SEQ ID NO: 16385 - DNA, 610 bp, Malus x domestica
  Predicted polypeptide sequence is orthologous to G748, G1900
gaacgaagagcctgcgaaagagaacagttccgaaagatgtgtttggatcccaaaaactttaaggatcgatgatcctaatgaagcagcaagaagctctatatgggcaacactcggcattaagaatgaaaagggaaactgtaccaatgagggaggaggtctcttcaaggcgtttcaatcaaagggagatgagaagaatcacgtggttgaagcttctccagtgttgcaagcgaaccctgcagcgttttcccgatcactcaacttccgcgaaagaacatgatcaaagctgaagtctgagtggtaaacttcggcaatgtgatgcaagggggtttacctccctccaacctttgctgctgacaaatatgacaccttttttttccattttcttttttaccgtaaggcaatgtttactgatcagcctcaatgtttctgagttagatcatatagatgtattttcttgaatctctgtgtaacattatggataggtcctttttgttttcacctcagttagttgctgcagaaagtgtttttatacatatttaggatgtgaggtaacataagatagctaataaaacgagagatatttggatgtaaaaaaaaaaaaaaaaaatcg

SEQ ID NO: 16386 - DNA, 600 bp, Malus x domestica
  Predicted polypeptide sequence is orthologous to G748, G1900
ttctttttttttttttttggatctccaaccaattctatcatagtatttcacatatatagagacatagatacgtacatggacataatctcagaaaaactaagtacatcaaaagggacctgtgcatagcgcaagaaggcaaaaatagttgccactaaagatttatcctagtgggaaccaatctcccacaagcgctttatcctacattagttcccctatcatactgaggaaccctagagagtaaagactgcccctccaattctgcatccccgattcgaccagctcaactaaaatggcctcagctggatggggtacctgtcaaaactcatggctacttggctagctagctacttcatgagctctcgtgaaagttgagggatctagacaatgcagctggatttgctcgcattgcgggggaggtttcagggacagttttcttttgatcactctttggttggaaggccttgaacagtcctttgccactgatggaatcgttcttgatcccgagcgttgcccatattgaactctttgcagcttcacttggatcatcaatccgtaatgttttcggaaccaaacgcatccatttttctgtcttgatggctc

SEQ ID NO: 16387 - DNA, 526 bp, Malus x domestica
  Predicted polypeptide sequence is orthologous to G752
attttttttttttttttttttttttttaatccaaagacgataatttaagcttataagtttaaattaatctaatgactcaaatgaaaaaggacagcaccacccactgtaataaaaattccaaaaagaaaaagaaaaacagtacatggataagttcagcatgttgattgtaacagtcgcacagcctattttgcaagtcctacaagcatccatcgcgcgtgcaaccacccgccaaggtcaaaaaatagtcttgcactaatgataatggaaaaaaaaggtggatggttggactggtttaacaacaccgttaaagtctaaacatgaacacaacaacgacatagctacatcaggatcagaccctcaaaatctgcctcatatttacatacaaaacacggcggaaaatatgaatgaaacgacgccgtcaaatcggggttccccgaattccggattcaggcggttcggtctgtccggttcttactttgactatgatgatgactataatgtatgtgctggccgcggttgtggccgg

SEQ ID NO: 16388 - DNA, 694 bp, Malus x domestica
  Predicted polypeptide sequence is orthologous to G760
tgtcaagccttcaattacaacgaaatagtacatcgaacgaaataatgtactgaaacaaaaattcagttttacattcattcagattcagtatatagctattcaaaatatcacacactttacgctatcttaaaacggtttgtgtaaataattagttctgcagtcggtgtaacaattaactaaaatatcgagtttgcaagaacttgcatcttcccctagtcactagggaaagtttactacaagatcctgagataggctcgcaaccaccattactgtcgaagcattacctggtacagatgtagcttccgattttgaaactcatagaaagaaacagaacccagagaaacataaacaaaaaccatccccgcatcaccacacatcctgtctttccagaaagtgagccaccgaccggcaccagattgccagagtttccgtcattctgcgacagctgaacagaaaacacaaggttgacaaccccatcctttccaaaagaccagtccatcctgttgtcacttgaagttatgtctctaattctaatcatgcctgcagtaacatgaaccgaactggaagacgatgcaccagaatttaacctaagcattgcctcctttagcagggaactcctgaagcaaatgcaagtggaagccgggaatgctgccccaacttcatgtgaactccccttttttgaaaggaaggggaa

SEQ ID NO: 16389 - DNA, 605 bp, Malus x domestica
  Predicted polypeptide sequence is orthologous to G760
cggagaatacgccaattggtgatgggctattccttgaagctaatgatctttcaaatccagtcgagtcaactgcaggttttgacatgcttgatgagtaccttacatactttgatgccaatgatgacatctctcagtatattgatttcgattcatatggaatgatgggggttgaaaactatgttcctgacgaagctccagctgaccagaagcttgtgaatggtgagaccgagccacaaccaatgggaggtgaacatgtacaaccagagccacagccattgggaggcgaacatcttgtacaaccagtggatactgatgatgcatcttcgtcaaagaaaacggcggagttcaagtttgagtcagatggtaactaccccttcatcaaaaaggcaagtcacatgatgttggggagcatacctgctccacctgcatttgcttcggagttccctggtaaagaggcaatgcgtaggttaaattctggtgcagcatcttccagttcggttcatgtcacttctgccatgattagaattaaagacataacttcaagtgacaacaggatggactggtcttttggaaaggatggggttgtcaaccttgtcttttctgtt

SEQ ID NO: 16390 - DNA, 692 bp, Malus x domestica
  Predicted polypeptide sequence is orthologous to G760
tcgaattccgttgctgtcgagcttaaggtctccggcaagaacttccgatttgaccccatctcggtcatcgacatctacaagactgagccttgggacctccctggcaagtcgaagctgaagactagggacttggagtggtactttttcagttttctggataagaagtatgggaattcgtctaggacgaatcgggctactgaaaaagggtactggaagactacgggtaaggaccgtccggttaaacataattcccgggatgttgggatgaagaagacgctggttttccatagcgggcgagcccccaccggtgccagaaccaattgggttatgcatgagtatcgcctttccaatgaggaattggagaaagctggaattcaacagaaggatccgtatgtgctttgtaggatattccaaaagagtggcacgggaccgaagaatggggagaagtatggcgcaccggttatggaggaggaatgggacgatgatgatgtgacctgtgtacctggtgaggaggcggctgctgatgtagtggcactcagcgaggagccacatgtggaagcaatttgtgtcaacgatggggcttatgttgaagcatttgaccttgatcagaatcttgacacaggaattccatctgaaagtgcacctcctccatcaaacttctattatggggagacgagccactacatttgagc

SEQ ID NO: 16391 - DNA, 646 bp, Malus x domestica
  Predicted polypeptide sequence is orthologous to G772, G776
atttgcttccctttcttggttgctcatttcaggatactcaggcaatcagcaaggctattgttgttgttcctgaacttccagcagagaatcaaactgtcttaccaccgtgcaagacagagagaacggatgattatcctatgacatgtgtggttaatagagaagagagattggatgactatccgtcaccaggtccagatgatgcacaacccctgctaactttgtttaatcgacaacctgggcaactacgccagtataaaagaaggcggcataatgagtcaaattctaaccattcaaatgcttctgagatttcaagtgggatgacacatgacccttgctcgtctacaacaacaacagcgtcaactgaggcatcgatgacaacgaccaccagaaattttctgtctgcactggtggagtatcagctgttggaatcccttgaacccaaagataccaccccagcacctcctcctgaacttaatgctgcattgatggaatcatctgtgcctaccagctgcttgaaatacatagagactttgcaaactgagatccacaaaatctcaatcgagagggagacattgaagtttgaaatgatgagtgcccaagccatgatcaacattcttcaagcccgaattgatctcctaaacaagga

SEQ ID NO: 16392 - DNA, 661 bp, Malus x domestica
  Predicted polypeptide sequence is orthologous to G773, G1412
ggatttggaaacttcagaaatttcaaatctctctctcccctctgtttcaacttctctttctctcgaatcttcccgatccagtttcgagctcggaaatttgtcaccggaataatgggtgtgccggaaaccgaccctctttctcagctgagcctgccgccggggtttcgattctatccgacggacgaggagcttctggttcagtacctctgccgcaaggttgctgggtaccaattcaatctgcaaataattgctgaaatcgatctttacaagtttgatccttgggttttaccaagcaaagcgatatttggggaaaaagaatggtactttttcagtccgagggaccggaaatacccaaatgggtcgcgacccaatcgggttgctgggaccgggtactggaaggcaactggaactgataaggttattacaactgaaggtagaaaagttgggattaaaaaagcacttgttttctatgtgggaaaagccccaaaaggcaccaagaccaactggattatgcacgagtatcgcctcatcgagccctctcgcaaaaatggcagctccaagttggatgaatgggttttgtgtcgtatttacaagaagagcagcagctcagcagcggctgcggcagcggcagcacagaagcccgttacgagcgtttcgagca

SEQ ID NO: 16393 - DNA, 410 bp, Malus x domestica
  Predicted polypeptide sequence is orthologous to G783
tagcaaaagctaagtgtgggggaatttgataggagcatatttatgcgccttagttagctagttcttatgcatctttgttatgttttctttgttaaagtagtcttttaagctacttccatgtgttttcaggtttaaaggacatattacatgaaatgatgcaagttggagcttttggagcaaaatatgagcttggattgaaaaggacatgcttggaacacaaggttgggatggaattgatgagttgaagatttgaggtttcctacttgaagtaggaaagctaagcctaaaagtttccattttgggttgatctttcctaaatcggaattggcaaccaaagtttctaaagttggaagtttctattcttggagggttccattttcgtgagtttctattctcgctttgggcttcta

SEQ ID NO: 16394 - DNA, 667 bp, Malus x domestica
  Predicted polypeptide sequence is orthologous to G791
tttaatcaaaaaaattgattccggaatattccttcccattgcgtttcccggccgaccacggcggcgctgcctctgcagggttcaccgccggaaattcggaatttccggcaagcattagaacatgggttccccgccgcagaatcccaactgggtcttcgattatggtgtgattgaggacattcttgtgccaggcggtgaacttccgtcgcttgacccgcccggtttctcttggccggatcattcatttgctggtccgactgctcccagcacggaatttgatgactcatttggaaatccagacagcatgaaggaaactgggttgcgaaaacgggctaggactggatcaaacagtgtgtctggttctaaagcatgtagagagaaaatgcggcgggatagactgaatgacaggtttgcggaattgagttctatccttgaacctggaaggccacccaaaactgacaaggttgctatactgggcgatgctgttcgaatggtaactcagttacgtggggaagcccaacaactaaaggagtcaagtgcaaatctgcaggagacgataaatgagttgaacgctgaaaagaatgaacttcgtgatgagaagcaaaggctgaaaccggagaaagactacctccagcgtcagattaaagccttgggtactcaacccagc

SEQ ID NO: 16395 - DNA, 688 bp, Malus x domestica
  Predicted polypeptide sequence is orthologous to G791
gaggatagactagtccccagccggaaaaccaacattttttttccggcggcctccaaacatggcctccccggaaaacaccaattggctcttcgattacgggctcattgacgatacccctgtcctggatgggaacttcgcttggccagttcagcccatcgccggttcatccagtgccagtgttgaacttgatgggtcattgggggatgcagagggacttaaggaatctggctcgaaaaagagggtcagaactgaatcatgcagtggaacaagctccaaggcatgcagggagaagttgcgaagggataggctaaatgacaagtttgtggaattgggctctattttggagcctggaagaccccccaagacggacaaggctgctattttggttgatgctgtacgaatggtgaatcaattacgtggtgaagcccaaaagttgaaggacacaaattcaggcctccaggagaagatcaaggaattgaaggcagagaagaatgaacttcgcgatgagaagcagaggctgaaatcggagaaagagaagttggaacagcaacttaaatccatgaatattcagcccgggcttttacctccccttcctgcatttcctgctgcatttgctgctcaagggcaagctcgtggaaacaagaatggtgccttccattgctacccctggggtcccatgtggcaattt

SEQ ID NO: 16396 - DNA, 554 bp, Malus x domestica
  Predicted polypeptide sequence is orthologous to G798, G1897
aatggatgcggcggcggtggcggcagtggcagcttcacttctctgctcaacacccacgggcctggtgggtttttggctctgggcgggttcgggcttgggctggcgggtgggtttgaggagatgggctttgggcttgggagagcggtctggccttttcctgggatgggaggagatggtgttgcgggtggggcccacggtgggatgatgaacatgtggcagctcgagaacggagagggtggtgggattgtgaatgtgggtgttggacccgtcggagctgagttctgttcgtggccggagttggcaatttctactcctggaaatggactaaagtgaaaggaaaatctttgtctattgggtctccttataattctctactctttttggtttgtaatggagaatgttgtgttttagagctctagggtttttaatgatagtgttgagggcttgagactaatttacattcaccaattaaatggcctttctatatatccaacaactactgcctaaattcaagtaaattttattttggttcaaaaaaaaaaaaaaaaaatgaa

SEQ ID NO: 16397 - DNA, 568 bp, Malus x domestica
  Predicted polypeptide sequence is orthologous to G801
tcgaattccgttgctgtcgaaccgtagctcctgtgccccacccccttcatcctcggcaagcgcgtccgcggttccctcgacgaccccgaaaacaaccacagccacaaccacaaccacgacgcctccgccgccaaggacccctccgacaaccacgccaacaacgacggagccgtctcagtcgtcgggcactccatggcctccatgctaggccccaacgcagggggacccggcgggttctgggccccgcacttcgggcaggtgtggagcttcgccgccacaccgcccccggagctgatggcccagtcagcgctgtcccaccagcagcagcaacagcaccatcagcaccatcagcagcattcgttgttcttgcagcagcagccgatgggcgaggcctcggctgccagagtgggaaattaccttcctggacatctcaatttgttggcttctttgtcgggcgggcacggaaattcgggtcggagagaagacgaccagcgttgaaaaacccgattgggttggagttccgtccgttggcggtggctggtggtgtgttttgttggtatatataaat

SEQ ID NO: 16398 - DNA, 704 bp, Malus x domestica
  Predicted polypeptide sequence is orthologous to G839, G1196
ttcctcttctgaaatggggagcctctgcctcggaaactactttagatggtcaaactccagttgcaatttgccggagattgactagaccaaaggattttttggagaacacacagacgggacaggaatctaacaaagaccgaatgtgcatcggtcttctagagagagagatgcagagaaactcaatctctgggaacatgtcaatcatatcggaggagatagccgatgatttgcacgtgaggctggactatctagaagatagagtggcatttgcgcggctgttgtttcctgctgagaccaagcttgctaaggaaatggcagatactcattcaacatcagtgtacagtggccttacagcatcaagaggatcaagtgggaacttacgagaggttgatttgaatgaaacgccctctggacgcaccaaaagactccaaacaagaatgcaagcccttcttaatactgtggaaatggggcggcgtttcttccccaactgctcggaagtgcttgataagtttttggacgatgagttggacatggcggatttcatcctcgaaaagggcactcccgaagagcaaagaatcaagaggacgcggttcttggaacttaaagaagatgtacagcaggcattttacaaggacgtggctgaacaaaaccggtcagcttcgtcattctcgtcatcgtcttcatcttccccgaaggagggggta

SEQ ID NO: 16399 - DNA, 502 bp, Malus x domestica
  Predicted polypeptide sequence is orthologous to G846
gagaaaaatggtggcatctgcttttggtgaagatcatggtgggggctctgctacacgtctgactgtcgaggatctgaggtacctctttatggtctagaacacaaccaagcgattcacaatcgtgtttttggcttgaatatccttgctgtctcaaagaaaagctggtcaggaaacaaagtttttgagaattgtagcagtagcagttgtagtagtagtgcccgataatgtaggctctaatgggactaatggatgatttgcatccgaacctgcatctgttttttttttttttcaacttcccgggctgaagacggcatttttgttcccattaatttgtgaggagcgagcgagcgagcatagggctagggtgactgactgtgaatattttctaatctattttattgtacaaaaagactgtactagtagtataccttccttcgttttagttatgttaataacatgataaatgatgttttatgtgaaaaaaaaaaaaaaaaaaaaaaaa

SEQ ID NO: 16400 - DNA, 767 bp, Malus x domestica
  Predicted polypeptide sequence is orthologous to G846
tgcaaagatccacctgaagaccctgttgttactatgtgtggccatgtattctgttatcagtgtgtttcggaatatttgacgggtgatgacaatacatgtcctgctgctgaatgtaaagaacaagttggttctgatgttgttttctccaaatccactctcataagttgcttctccaataatcttgatggtactcggacgaattctgagttgggcgagaaatcaatagtgttacagaatgagtatagttcatctaaagtcagagctattattgagattttgctttcacatttggaacataactgtgctggaagcaatggagaccctgcttttggaaccgaaatcacagatagtagatattctggcgtttcaagctcaccaaatagtggaccaataaaaacgattattttttcccagtggactggcatgttggatttagttgaaacatcattgaacgagtattgtattcagtacagaaggcttgatgggacaatgagtctggcatcaagagacaggggtgtcaaagattttaacactgatcctgagatcactgttatgctcatgtcactaaaggctggaaaccttggtctaaacatggttgcagcatgtcatgttatccttttggacctgtggtggaatccaaccactgaagatcaagctattgatcgggcacatagaattggacagacccgacctgttactgtaacacgtctcacgattaaggatacagtggaggacaggatattaccttttcagaaaaaaagaaaaaa

SEQ ID NO: 16401 - DNA, 535 bp, Malus x domestica
  Predicted polypeptide sequence is orthologous to G849
gggcatttctcaggatgacaagcgacataatttgggttttatattggagcccaaacgggcaaagcttacgtaccctccattcagtgaagatccatctttggtatctggcaggtctcaggagttaaccaggcattcgacatctttggtgccacaaccggggacttcagatgtctcaatgaatcctgcagtactcagtttgggtggctgcagtgatagagacttcaaggaagttccttctcttgctagtacttcgattggcaaaactccgcctacatgccaagctcttgttgcagttccaccaattagcatgaaggcattggctgtgggtcctttccatcggaaatctgggcatcaagagtatgtacagcgccgaatgaggagacctttctctgttccagaagtagaagcattggttcacgctgtcgagaaacttggaacgggaaggtggcgtgatgttaagttgcgtgcttttgaaagtgaaaaacatcgaacttacgtggatttgaaggacaagtggaaaacactggtgcacaca

SEQ ID NO: 16402 - DNA, 651 bp, Malus x domestica
  Predicted polypeptide sequence is orthologous to G849
aatgctggaatcgcaggcgctagttcgctatttccagaaatcgagcaaggagccactagccgtagtttccagcgagccagaaaactaagcgatcagagctcgcacagcgtcgaaccaggagaccattctctagtctcagaagtcgaagcattcggtcgaccgcagttgaggaacttaggcactggaagagtaggcgcgatgttaaattgcgtgcatttgagaatgcagaccatcgaacttacgtggacttgaaggataaatggaaaaccttagtccacactgcgaaaatctctccttagcaaagaaggggagagccagtcccgcaggagcttttggaccgagtgttggctgcccattcgtactggtgccaacaccaagccaagcaacacggcaagcacccagccttgccggcattctgagatcacagacccacccgaccgattggcatggagcccgattggcatggagctcaaaggtatccaattgtatgatgtagaaaaaaaacaggaaacgttgacagaaacagggaaagaagataaatgtacaaatgacctgaaatttgtgtaaaatcctcaccccccccccccagaggtaaattcaattgccggcgtctctgtctgagggaggccggcaaatgtaaatggttcgccg

SEQ ID NO: 16403 - DNA, 498 bp, Malus x domestica
  misc_feature (15)..(15): n is a, c, g, or t
  Predicted polypeptide sequence is orthologous to G852, G2633
ttttttttttgcagnaaaagtgagagctattctctttctttgcaaggccgacatttttacatcaccgaatttcgagattcaggtttgggactacaactaggaactcttcctaccaaaatttacacaatcagtctttcatgctctaagcgtcataaaataacaccaaattagaaattttacaggttttgcagtcaccctctggttcacctccatgcagaagacgttgccatatctctttgcatccaactaaggtagagagccccatttgcctcttgaactctaaaattcccgtgatattccttcaacagaaccctgatagcctccgtcactttaggactcagcgggtatggagtaaatccatccatcgttagccttgacctccacttcccgaaaggttcatggcgttccaccctctcggctccttcacaagcaaccatgttcacgatgtctctagccacacagtgcatctctgcgctgatccgctgtttgtcatctctt

SEQ ID NO: 16404 - DNA, 736 bp, Malus x domestica
  Predicted polypeptide sequence is orthologous to G852, G2633
caaggggaaccaatacataaccctcatacaaacactttcgagtctgccaggtaagccaccacacttgaagttaacaggggtggatgatcccgagacagttcagcgtcatgttggaggcctaaagatcattggacaaaggcttgagaagctagaagcactgaaagttccattcgagtttcatgcagtagcctcgaggacttcaatcgtcaatacctcaatgctcggctgcaggcctggggaagcacttgtggttaactttgcttttcagcttcaccacatgccagacgaaagtgtttcaacagttaaccagagggaccagcttcttcggatggtcaagagcttgaggccaaaactcgttacagttgtagaacaagacatgaacaccaatacgaccccttttctcccaagatttgttgaagcctacaactattactctgctgtttttgattcccttgatgcagctctcccccgggagagtcaggataggatgaatgttgaaaggcagtgtctggcacgggacatagtgaacattgtagcgtgcgaaggagaggaaagaatagagcggtatgaggtagctgggaagtggagggcaaggatgaccatggcaggatttacttcatgtcctatgagcaccagtgtgactgattcgattcgggatcttaacaaacggtaccgtgagaggtacaaggtgaaagaagaggcgggggcgcttcatttcggatgggaaaaaaaaact

SEQ ID NO: 16405 - DNA, 337 bp, Malus x domestica
  Predicted polypeptide sequence is orthologous to G866, G883
ggatattacaagtgcagtacggtaagggggtgcccggcgaggaaacacgtggagcgcgctccggatgatcctgcgatgctgatcgtaacgtacgaaggggagcaccggcacgcgccggagaacgtggggttggtgtctgagtcgacgtgagtgaaagtgggtagaaagaaaagaaaagtgggtagaaagatggatttgttccagcagtttgaagtagttgagaggaaggtggtggaactggaatggatgtaaatttttatttttatttttaaatcttgtagtttaattaagtggataatgggaaacaaattgagggaaaaaaaaaaaaaaaaaatcg

SEQ ID NO: 16406 - DNA, 583 bp, Malus x domestica
  Predicted polypeptide sequence is orthologous to G878, G884
gaacctagaagtaaaagaagaaaaagtgagaatcattcccttgaagcagggatatcaggggaaggtgtccaagatcctcgtgttgtggtgcaaaattctgttgaatctgatatgacgggttatggcttccgctggaggaagtacgggcagaaagttgttaagggaaatccatatcccagaagttattacagatgtaccagtctcaaatgcagcgtgcgcaagcatgtcgaaagagtctcggatgatcccaaagctttcatcaccacgtacgagggaaagcacaaccacgacatgccactgaggaacacgaacgcaggagcatctgagaaggatacaacaactaaagaaaagccatgagtgagtgacaacatcacattcaaagtttggcatcaaactgtttcaaccccatgtttgtctgacagaaatgtcagatgggctcagagtaaaaaacagacaccaaaagtaactgccgcagtgattctgattcccgccttggatgctctgctctgctatgcaatcccaatcatttcacttgggaatctctttgatggctgcttgatggattggagacataaaatggtgt

SEQ ID NO: 16407 - DNA, 179 bp, Malus x domestica
  Predicted polypeptide sequence is orthologous to G881
gatcaactactgaaacttactgatggtgctgttggtgatgatcatgatggtcttcgtcagccacttttcattctgcaggtacctgcgcatataatttgggtcatcatcatttgttctgcataaagctagctaacaagataataaagcagttccaatttgtttgcaaaaaaaaaaaaaaa

SEQ ID NO: 16408 - DNA, 624 bp, Malus x domestica
  Predicted polypeptide sequence is orthologous to G896
atgcgccgtgtcgtataagcggtcccggcacgaactcaagggctgcattaacgacgccaagtgtatgaagtacttgctggtcaacaagttcaactttcccgagtcctccattctcatgctcaccgaagaagaagttgatccttataggcgcccgaccaagcaaaatatgagaatggcaatgtattggcttgtgcaaggttgtcaaacaggggattctttggtgtttcattattctggtcatggatcacaacagaggaactacactggggatgaggtggatggatttgatgaaacgctttgtccttcggattttgagactcaagggatgattgttgatgatgagatcaatgcgacaattgtcaggcctctacctgctggggcaaggcttcatgcaattgtggacgcttgtcatagcggtactgtgctagatttaccatatctctgtaggatggacaggaacgggaagtatgtatgggaggatcatcgccctagatcaggtgtttggaaaggaacaaacggtggagaggccatttcctttagtggttgtgatgatgatcaaacctctgccgatacctcagctttgtccaagattacttcgactggggccatgactaatgccttcat

SEQ ID NO: 16409 - DNA, 672 bp, Malus x domestica
  misc_feature (603)..(603): n is a, c, g, or t
  Predicted polypeptide sequence is orthologous to G896
agaagccaaatcattcgctgtgatgcgtgtgaaggcatcacccgcattagtagatcatccgtcaatcctctgatccgagcaggccaagatacaataaaccacactgtcaaccgtgttaaaagccgaatgactagagtgatgtccatgccctccccgaatgctgcccgccctgctaatcctcaatactaccagcatcagctgtcccagccatttgtaccaaaacccttgatgcctccttcggcgtatggaagaaagcgcgcggtgctgtgtggagtgagttacaatgggaaaagttacaagctcaaaggaactgtgaacgatgttcactgcatgaaatactttcttgttgacagattgggctttccaaatcattccgtactcttgctcacagaacatgagacggacccttttaggatcccaacaaaacaaaacatgcgaatggcgttacagtggttggtgcagggctgccaatcaggagactcgttggtgttctacttctccggccatggctcaacccagcctgactattcgatggatgagattgacggcatcgatgaaacggtgtgccctgttgatttcgagaccgaggggatgatcattgangatgaaattaacgccacctttgttaggcactgacccatggtgccaacttcatgcattatcgatgcctgc

SEQ ID NO: 16410 - DNA, 683 bp, Malus x domestica
  Predicted polypeptide sequence is orthologous to G898
aaatctctgatcgaaggttttaaaatcttcaacttggatacaagatttaatataacatgagcactcggggggccagggcgccacatgcaagagggcggcgaagaaagaatgagttgaacttggacctcaatagtgccccacctggtgacagtcgggaacaggagggaacttcaactcagtcagtgcctcagaataatcaagcgactttgcaagttcagcctataccacctaatacgattgatgttgaggctattgatgatgatgttattgaatccagccccacggcttttgctgaggctaaaaacaattccagaaggaacctgaggactgttgttgatgtggaatcaaaacggacggctagggtcactcaaaacaagcgcagaagagttggaccaaaccaaacaattattaattgtgatttctacataaatctggaaagcaacagcaactccacctccacgaaacaaaatgttacacagccacctccaccaccaccgccaccgaaggagcccacctttacctgtcccatttgcatggctcctttagttgaggaaatgtcaacaaaatgtggccacattttctgtaaggcttgcattaaaactgcaataggtgcgcagggcagatgccccaactgtaagaaaaaagtaactatgaaagaactgaataaggtattcctccctacg

SEQ ID NO: 16411 - DNA, 672 bp, Malus x domestica
  Predicted polypeptide sequence is orthologous to G898
gttgttctgctcctctcgccggtaaagcacatagcgcgaatccctttccgcagaagcatggcctcacactcattggggcaatctacagaagggaaaatgaggaattctcaaagggggaagatgccactaattgtggacctcaactatccagctccttgtgaggacatggttctaaatgccagatgttcttgggacaatagtcaacaagttcaggttgaaatatatggtcggtcagaagcacaagcttcaaatgattgtgaggttgtcgatgatgaagttgtcataatttccccaagggccaagaataactccaggagaaaccttgaggtgagagatgggtctgctacaaactctgaaaggcaaaatggccatacagatgtgcctcctcaattacctgtacctctacttcctcttcattgccacaagcgtagaagaactttacgaaatcaagcagttttgaattgggagcatcattttagcttggaagacaatgacgaaaacaagacaaaggaagtgtctattccagaacttgctgagaacacgccacccccagagacaccctccttcagctgcccaatatgcttgggcccgttgaatgaagaaacctcaacaaagtgcggtcacatcttctgcaagatgtgtattgaagcctcaataaaagttcagcccaaa

SEQ ID NO: 16412 - DNA, 335 bp, Malus x domestica
  Predicted polypeptide sequence is orthologous to G913, G976, G1753, G2514
tggagagtccaaaaatgggacagatgcagaaacacgaggttgatgatatgatgatgagtagtacaagtttggcttcttctgtaggatactttatggacgaggaagagcttttccaaatgccgaacttgctggtggacatggcagagggaatgctggtgtctccgccgagaatgaacgactctccaccgtctgattatgatgacttgccgggaaattcagacggaagagaaggtcgtctgtggagctattagtgattatgcagctcacaccctaaattaattcacgctcaaaaataaagataattataacatgaaaaaaaaaaaaaaaaaatcggt

SEQ ID NO: 16413 - DNA, 651 bp, Malus x domestica
  Predicted polypeptide sequence is orthologous to G921
ggtggagatgattcatcacgtataagagtcatagtccggattggagagagacgttcgactccacgtgtccgctgaaccagttccgaagtagcaagacgagtgaatgaaggcgctgtaagcggaagtgaatactcgttccatggagacagatagatagaaagtgtgcagtgagggatctttctaggtagtaactactcgtacagaaaggagtcccaatgtccacagatctgtgccttcaagagcgtttgctattgaatgtgctcttgtcgcaattgaatcagaatctgcagctattgactcagctgctctcgaagttgctctttgcgcactcataggtgtgggactttcttttttcgttttagtaaaatgcctccggcagcagcaaggctatcttaaattccaattttcaatgattgaaatgcattcctctgtattctgttgtgctcagcgaacgggtaaaacccaggatgggaagtcgcatctctttcggagttgaatcgggaatcctactttaaaaaagaatctaatcatgggctctcaggtggcaaaggtctgccttaccttaccgctttccagtcatccatgctgctcctacaagaaaagggtcttcggccagctttccagaaagaaaggaattactaaatacagaaa

SEQ ID NO: 16414 - DNA, 577 bp, Malus x domestica
  Predicted polypeptide sequence is orthologous to G929, G2344
gaagaggagcctgtgtatgtaaatgccaagcagtaccatggtattttgagaagaagacagtcacgtgctaaagctgagcttgaaaagaaacttataaaagctcgaaagccatatcttcatgagtctcgacacctgcatgcattaaggagggcaagggggtgtggaggtcgcttccttaataaaaagaaacaagatgataacgacgaaaattcctcactagaaaagggcatgaattatgatggaaaccattcagctgaatctgccaaatctggttttgagtgctgtccaaataccagcaatgggaattttgattcctcaaatgtccagcaagacagatcaggtcaatggctcaggacacacagccaccacacacactctaatggtaatggcaatggtcatggcccatcatcagcatacccttccacgtttggtgacagcaaggaaagtgtgttcctgggtcaacagagggaaaacatgcagttgaatgggttgtctcgcggcgccatccccagtaaatgagatccctctacgaggtttgggtcccctcttgacagggtttcagttcatgtggcaagcc

SEQ ID NO: 16415 - DNA, 617 bp, Malus x domestica
  Predicted polypeptide sequence is orthologous to G937
ggggaggggccttactggcattcaagggtcagaatgagttgtctggttttgcaaacccacgtttgaagggagacaaggaggttaccgtggttccaaacctttgtcttatgactccattgatgtctgaagcactggctggttctgcaaatgcaaactctaagaccaaccatggctgcagaggtggcggttcgggttctggtatggcaggacaattgaaattacagaacaaaccccaacagcagccacagcagcagcagcagcaacccttaaggaaacaaaggcggtgctggtcggcggagctccatcgccgctttgttgatgcccttcagcagcttggaggaacacaagccactcctaagcagataagagaacttatgcaggtggagggtctcaccaatgatgaagttaaaagccacttgcagaaataccgccttcacatccgaaagctcccgccttcttcggctgctggccaaggcaatgacttactcgtgcccgtggatcacagtggagagcatactaaggcaaacaacgcacagtctggttctccacagggtcctctcctcgcaggagggtttgccaaaggccgatccacaactggaggcgagtcgggcgacagc

SEQ ID NO: 16416 - DNA, 645 bp, Malus x domestica
  Predicted polypeptide sequence is orthologous to G938
ttggaattgctgaggatgggcagaaaatgatatccgagcttatgtcattctatgatagtaatatacagcaaaacaagaactgcaatcctggaaacctaaatgatgtagatgattgcaatcagcagcaggctaactttcaatttccaatgaatgataacttatgtggtcaagggctggacataggacgcaacatgaacatgtcggaacagtcccccatgcctatgcttcatccagatttttcatccccggaagttcagtttgatcaattgatggcatttgattctccatttggtaacaattccaacgaagatgtcgacataagatttggctcccccttgcacttgtcacctgttggttataatgttatggacccgcctctgaaccaagacccctggttcccatgaagtgggtttttcttatattgactgctccaatatatacgcgttggagtcccacagtttaggtgaagcttcttttcaactttacttgcttctcttatcttttggacttgttagatgtctatatgcctaatatgtcataacccaaatctgtgtttgcgggtggtttacacggttgagcaaataaagaagccttgttgtgtttagttgcttatttatctgctggactttttagacgtttataacc

SEQ ID NO: 16417 - DNA, 562 bp, Malus x domestica
  misc_feature (505)..(505): n is a, c, g, or t
  Predicted polypeptide sequence is orthologous to G956
taaaagagacaagaagaaggggggggcgagtgttacctgaatctcctcaacgcccctgcagcatattctaattgcttcttcccaactgacatccaagaaacttcagtcgctaatccatagttcccaatctccgcccaacttagttttcctcgaactttgtagggatcacaggcattctctggagctaatacttgagagttactctgtatgtcaacctgtgggctctgcacccatgatgaaatcaccgaccgttcagatgatgaccaccaagaggaattggaaagatgtccgcgtggtgacatagacgagcattggctctcttgcactgaagattttgacggtgtagctgaatcagccaaagatatgaatatatttttcatgcatctcaccatctcctctgacagttgatttggatgatcccagaggcccttggggggcatccctttaggaagcctcctgagctcagcagggtgaaaagattcagaatccatcttcctcgacattntcatatcaaggcaatttgcaatggagtccactgcattctgataataagaatcacaaa

SEQ ID NO: 16418 - DNA, 562 bp, Malus x domestica
  Predicted polypeptide sequence is orthologous to G958
tcctccatctatggttggagagctacacttgaattctatcgaggccaagcccctcatgaaactaaaaccaattgggtgatgcaagaatactggataactcagaagaaatcgtcggaaagcagcaaattgaagataaatgtgcaggatgtcgggtcgctttgcagagtctttcttagggatgatgaaacaccaaactccaataagcttcaggaattggtgaattctgatagggctgttcactcaacacattcagttgttccgcgtgttgaggaacgtggttccaccagcaagcctcgtgttgaaaatgaggcaagcaatgatcgcgaaacgggaacattggtagttacagaaaggcttccagttcgagatgataatgtgcaaattatgcacgagaatgattacctttcgaggggcgactacttggaattgctggatcttgacacaccagcatctcattcatttagttcagtttcgagttgcttgacaatgtcctcggacgaatgcttccattctctggcattgttggaagaactagagcctaaaagtaagcaagaattggtga

SEQ ID NO: 16419 - DNA, 602 bp, Malus x domestica
  Predicted polypeptide sequence is orthologous to G962
taaacttctggttcatgacagtatgtgattcaattgtccttatgtatgtataatacaattcactcgacaaaccacgtaacttctccaatatacgcttctgggtatcattggaggtaatgcatatatactccacattttttgcatttttcatttcaatgtggtatccatttaaacgtatgtctttgaaactcaacaaatttcgagtagatcgagtagcatacaatgcattctatatggacaatattgttccatttggtaacataatctgagctttccttgagtcttcaattatatttgattggcctaatattgttgttacccttactcttgtaagcatcaagcttaagaaataattttgatcacgaagtattgtatgtgtggttgtgttgtctacaagacaaatatctgcaccatttctcatgttctaagaataaccatagtttttatccatactttctgagtaaatggaatcacagttaacaaacaatttataatagaaaattgaaatgctagttttaaactacaagtttagaataataatagtacatcaaacataaatgattcagttagaccgatacacttcattcctcctttccacaatg

SEQ ID NO: 16420 - DNA, 503 bp, Malus x domestica
  misc_feature (481)..(481): n is a, c, g, or t
  misc_feature (489)..(489): n is a, c, g, or t
  Predicted polypeptide sequence is orthologous to G975, G1387, G2583
agttctgatcatgatcatcaagaggaatcactgtcatccttgacgtcatcgtcaatggtggggttgactgagggtggaatgagtgaggcagatcaggatgaagaggataaacttgcaatgcagatgatagaggagttgctgaattggaattatccaataccttcagccacaagtaatgttcacgaaggaaataatatttaaagggaattctatatgccggagttcttaaccgttaagttcttgataaaaaacaataattggaatttaacagttaaaaatttcgaagtatagaatatttcaaagtacagtagaaatatcgatagatattaccaaccatctgagctgcttgaattcctagtgttattagtcctcgaagtaaggaggcagttaagtgctcaatttgcagctacgtacggtagttaattaaatcataaaatgccaccacactgttgttttgtgattggtgattaacttgtagaanaaaaaaanaaaaaaaaaaaaaa

SEQ ID NO: 16421 - DNA, 433 bp, Malus x domestica
  Predicted polypeptide sequence is orthologous to G975, G1387, G2583
ggtgaaatcgaaaaagtacagaggcgtcaggcagcgccactggggctcttgggtctcagaaatccgccaccccttactgaagagaagggtgtggctaggcacatttgagacagctgaagaagcagcccgagcatacaatgaagcttccgttttgatgagcggacgaaatgccaagaccaatttcccaataacaactactacaactcatagtaatggtacccgtaccacagtaggatcatcagatcacccaaaaactagtagcggcgacatggattcacgatccgaacagaagggtctgtcggaaatcttgcatgccaagctaaagaaatgcggcaagataccatctccatccatgacctgcttgaagctcgacaatgagagctctcatataagagtatggcaaaaacgtgcaggtcaacgctctgataactcc

SEQ ID NO: 16422 - DNA, 697 bp, Malus x domestica
  Predicted polypeptide sequence is orthologous to G977
cactttcgaaaagaaacgtttcttttgcacagcaatggcgagaccacaacagcgatatcgaggcgtccgacaaaggcactggggctcttgggtctccgaaatccgccaccctttattgaagactagaatttggctgggaacgttcgaaacggcggaggacgcggcgagagcttacgacgaagcggcgaggctaatgtgcgggcctagagcaagaacaaacttcccttataacccgaatgcgtctcagtcctcggcctcgaaacttctctcggcaactttgacagcaaaactgcacagatgctacatggcttcactccagatgaccaaaacttcactgcaagagccaaaaaagccgcaagctttagcgtcatcgggcgcgaaaatgccggatatcaaaccggaaattcatcaaccagtagccgaggaaaattgggttgtgagggaagtaaaagtagagagcagcagccagcagttcaagccacttgaagatgatcacattgagcagatgattgaggagttgctgcattacggttccattgaattatgctctgttttgccaccacaagctacctaaagtgtacttctttactccgcccgccggttcgcctggcagtggtctcgctggattagtacaaggaaccgtgaaaatctagttaatcaattcatgcacgttactgattagaatcatttcaaaaac

SEQ ID NO: 16423 - DNA, 638 bp, Malus x domestica
  Predicted polypeptide sequence is orthologous to G987
agacggggcgtcgcttgaaaaaatatgctgcaagatttaatgtccagtttgagtacaaggtcattgcacggaaatgggagactatccaacttgaggatcttaaaattgacagaaatgagctaacggtggtgaactgcatgcaccggttaaagcacatacctgatgaaaccgtggtggtaagcagtcctagggacattgtcctaaagttgatcagaaaaattaatccagacctatttattcacggagtcatcaacgggacatacaattcacccttctttgtcacacggttcaaagaggcgctctaccacttctctgcaatgtttgacatgtttgaggccactattcctcgagaagatgagcagcggctgatgtttgaaaaggcagtatatggtaaagacataatgaatgtcgtcgcgtgtgaaggactggaacgagttgaaaggcctgagacatacaagcagtggcaggttaggtatcatcgagctgggttcaagcaggtgcctttagaccaggaactcttggaaagagtgaagattatgctgaaggcaatggattatcatgatgattttcgaataaatgaagatggcgagtggatgcttcaggggatgaaaggcaaaatcatcttccagtcctgcgtt

SEQ ID NO: 16424 - DNA, 184 bp, Malus x domestica
  Predicted polypeptide sequence is orthologous to G988
ctagcctttcattttcaagaataaaaccatataaaagaaggaaagaaagaaagacgagaataattacggacggtcgaacctgccaagccttggtcaagctgtttcgtatgtatcaatagttcacaacaaaagatggcacatatttaattactgaaaggagtttggttttttgtaaaaaaaaaaa

SEQ ID NO: 16425 - DNA, 562 bp, Malus x domestica
  Predicted polypeptide sequence is orthologous to G1017, G2567
ttttttttttttgaatcggagtagcttctccgacaacttcacgaagggtaaagggtcagcatggggagctgtacaattgaatcgaggcttacttctttctttacattcctacattgttgctgcctaaatccattagaatcgtcaatctccttgccgttttcatgaaatcactgcaacttcaacaataatttgatcaatatattaccttacaaacgattcatttgataattaaaagggcaaaaacctccgtcatttggagccattacacggttcaatgggaattgatccgtacctgaaaggttcatctccaacgtgtttaactgcaccagtaccatctcgatagagcacatggttcagtgtctccgaattgtctatgccaaacatatctgccagttttctgtacaactcatcataggacccaagaagtgaaaggtcaagagtacgacctacatcttctgattccatgaagactttacagtgaccagtttccagatttggttcggtttcatgtcgattatccttataccattggaaaccctcacaagatgagcgctcttgtatg

SEQ ID NO: 16426 - DNA, 397 bp, Malus x domestica
  Predicted polypeptide sequence is orthologous to G1020
agaatccgacatccaacgagatccggtaccggggtgtccggaagaggccttggggacgctacgccgccgagatcagagatcccgggaagaagacccgcgtctggcttgggaccttcgacaccgccgaggaggcagcgcgtgcgtacgacaaggccgcgcgtgagtttcgcggaggcaaggcgaagactaacttccccaccccctctgagctccagctcgacgccgtcaacatcgtcaacatgaacaacgccgccaaatcagcggcggcgacgaacgtcagcaacagtcccagcagccagagcagcaccgtggagtcctcctcgccgccgcctccgccgccactcgacctcactctcaaaaacccacccgacctttttctaaaaaaaaaaaaaaaaaa

SEQ ID NO: 16427 - DNA, 645 bp, Malus x domestica
  Predicted polypeptide sequence is orthologous to G1023
cacgaggtaaaattcattgcagaagcttcatagtacattaccacatcagggagataaaagagagatgataacgttaaacccttctacgacaacaaatcagatcgagaaccctttggacggctctgatagcacaagaaaacccaaggattcacacttaacactaaaacgcttatgccgcaaatcaccatcttaatctctctttaaacaaacaaaataattaaactctcacataattaccactctcactcgagaactccatgtgttacttgagagttcatgatattacgcctaattgctgcaaaaccataaacagagatttaactaaagagaagctgcaaaatttattggcatactatgttgaggggttcatccaaccagcaagcaatgtcatccttgccaagatcctcaaagtcacagtcgggtagactgctcggctcatcgctttcgaacccgggaatctgtatatcctcaatgctgctgtaattgtcgaacaactgcccaaaatcctccaggtaaagcgaatcgagctccggtcccaagtttagctcttgatcaaaatgaagagggcccaatgtctcatcaagaaaacccaaatcgggtatttgcagctcttcaagatttgtcgactcatcggcaatctccttc

SEQ ID NO: 16428 - DNA, 666 bp, Malus x domestica
  Predicted polypeptide sequence is orthologous to G1033
ctcgatggaccggatgacttcccacaaatatctctctactttttatgtctttggtttcttagcttgaacttgctttagccacactactctctctctctctctctcctttcccctgttgcgttcgcttctctccaaaaccaagagaaatcagtctgttgagaatgaaggcttccaaaggcaaaggacctgtgaggaaggacaagaaagaagtattaaagcctgtcgaggacgtaaaggtgggaaaacgaaaggcggcgattgaggctgacaagagccgccgaaaacttgccaagaacgcaaaattgggcaagaaggaccccaataaaccaaagagacctgcgagcgctttctttgtttttctagaagagttcaggacggtttacaagaaagagcatccgaatgtgaaagctgtgtcagctgtggggaaagctggtggagaaaagtggaaatctatgtcacccgcggagaaagctccatatgaagctaaagcagcaaaaaggaaaacggagtatgaaaaacttatgaaagcttacaacaacaaagaggatgagacggaggatgacgaggaagaagttgctgaaaagtcaaaacccattgcgaaggttgttgaagaagaagagagtgccgaggaagacgatgaagaagatgatgacgacgatgaagatg

SEQ ID NO: 16429 - DNA, 631 bp, Malus x domestica
  Predicted polypeptide sequence is orthologous to G1033
caaaaacaagggcgtagtttactctctctctccgcgtcttcgtcttgttctcgaaaaccctaggtaaccttgcgcctccgccgctctgactcggtccgaatcgagcagtttttgaccgtttccgaacgattctcgccggttcccaccgatttttgaccttttttgtgtggttgcaggttcgccatgggtaaagccagggctgctgcccccaaacgcgatacgaagttgaagagcaagagtgccggagcgagcaagaagccggcgaagaaagccggaaaggatccgaacaagccgaagaggcctgcgagtgccttcttcgttttcatggaggacttcagagagaagtacaagaaggagcatccaaacaacaagtcggttgctgccgtcggtaaagctggtggcgataaatggaaatcgttgtcagatgccgagaaagctccctatcaagccaaggcagacaagaggaaggtagaatataacaagaacattcaggcatacaacaagcaattagctgatggaaataatgaagctgatgaagaagagtctgacaagtccaagtctgaggtaaatgacgatgatgaagacgaggacgagagcggcgaggaggaagacgatgatgagtagagagtag

SEQ ID NO: 16430 - DNA, 681 bp, Malus x domestica
  Predicted polypeptide sequence is orthologous to G1033
aaaaacaaaggcgtatttgctctttctctctctgcgtcttcgtcttatttccttctcgaaaaccctaggttcgccatggggaaagccagagcagctgctcccaaacgcgatacgaagttgaagagtaagagtaccggagcgagcaagaagccggcgaagaaagccggaaaggatccgaacaagccgaagaggcctgcgagtgccttcttcgtcttcatggaggagttcagagagaagtacaagaaggatcatccaaacaacaagtcggttgctgctgtcggtaaggctggcggtgagaaatggaaatcgttgtcagatgctgagaaagctccttatcaagccaaggcagataagaggaaggttgagtataacaagaacattcaggcatacaacaagcaattagctgaaggacctaatgaagctgacgaagaagagtctgacaagtccaagtctgaggtaaatgatgatgatgatgaggatgaggacgagagcggcgaggaggaagacgacgatgagtagagcaacgggaattgaatggagggggagaagcgatatgtgtagggttgcttagaagataattcaaaggcctgcctgcaccttttcttcactatgggataagttgctggctctctaccttttgttttaggggttagtttttaggaaaacacaaaacaaaatcgg

SEQ ID NO: 16431 - DNA, 572 bp, Malus x domestica
  Predicted polypeptide sequence is orthologous to G1033
acaaccaagggcaaattttacacacgcacaccgcaccaaaacaaagcaaacgacccaaaggcatatctctctcattattctccatctctgtctctgcgtcgtcgccttatcctctcccttcaccaaaggtttagctgaatatggggaaatcaagagctgctgctcccaaaaaagccgatgcaaagttgaagaccaaaagcgctggcgcgagcaagaaggcagcgaaggatccgaacaagcctaagaggcctgcaagcgccttcttcgttttcatggaggatttcagagtgaaatacaagaaggatcatcctaataacaaatccgtcgccgctgtcggtaaagctggtggtgataaatggaaatcgctttcagaggctgagaaagctccctacgttgccaaggcagagaaaaggaagaccgagtacaccaagaccatgaatgcgtacaacaagcgcatagctgagggaggcaatggagcggaggacgaagagtctgataagtccaagtccgaggtgcaaaacgaagacgaagatgatgacgagagcggagaggaagaagatgatgatgagtaa

SEQ ID NO: 16432 - DNA, 476 bp, Malus x domestica
  Predicted polypeptide sequence is orthologous to G1033
gaaggtagaatataacaagaacattcaggcatacaacaagcaattagctgatggaaataatgaagctgatgaagaagagtctgacaagtccaagtctgaggtaaatgacgatgatgaagacgaggacgagagcggcgaggaggaagacgatgatgagtagagagtaggggaatcgaaatggaaggggagaggcaatgtctgtagggttgcttagaggataattgaaaggtctgcctgcactttgtcttcaccatggataagttgctggctctctacttttgtttttagggattagatttaggaaaaacacaaacgaaaatcggattaagtttgaagattgtctgctcccctcgattcccatatcgttgtctttgtacttaatgatcctccttatgttcaatgaatttcagtttgctttcgtaacataatgctttcgttagtttcttattatgcaaaaaaaaaaaaaaaaaatcggt

SEQ ID NO: 16433 - DNA, 484 bp, Malus x domestica
  Predicted polypeptide sequence is orthologous to G1033
gttgccaaggcagagaaaaggaagaccgagtacaccaagacaatgaatgcgtacaacaagcgcatagctgagggaggcaacggagcggaggacgaagagtctgataagtccaagtccgaggtgcaaaacgaagacgaagatgatgacgagagcggagaggaagaagatgatgatgagtaaagaaggaaagccggaaatcgaatgaaggagaggagcaattcgtggttagggttattggttagaacatatcgaatgacctgcattttctgattaaagctttgtgtctgatgataagatagctacatttttaggattagggaaggaaagggaaaaacacaaggggttatgtttcgggactcatccacctgattccccatatcgtttctgtacttaatgatcgtttttatgttcaaattacttctgttttgctctaattagtatcccttttattaaaaaaaaaaaaaaaaaaaaaaaaaaaaaaaaa

SEQ ID NO: 16434 - DNA, 490 bp, Malus x domestica
  Predicted polypeptide sequence is orthologous to G1033
ttatctctctcattgttctctctctcgccttatcctctcccttcacacaaaggtttagctgaactaggggaaatcaagagctgctgctcccaaaaaagccgatgcgaagttgaagaccaaaagctctggcgcgagcaagaaggctgcaaaggatccgaacaagcctaagaggcctgcgagtgccttcttcgttttcatggaggatttcagagtgaaattcaagaaggatcatcctaataacaaatctgtggccgctgtcggtaaagctggtggtgataaatggaaatcactttcagaggccgagaaagctccctacattgccaaggcagaaaagaggaaggctgagtacaccaagaccatgaatgcttacaacaagcgcatagctgagggaggtaacggagcggatgatgaagagtccgataagtccaagtctgaggtgcaaaacgaggatgaagatgatgacgagagtggagaggaagaagatgatgac

SEQ ID NO: 16435 - DNA, 672 bp, Malus x domestica
  Predicted polypeptide sequence is orthologous to G1037
ctacaatgagcaataattctgggccaacaattaacaatgacctgtttatggggtgggatgaaccgaagcaggattccccgttccgcccagatgtcatgtgtagctcaatgaacaatttgatgcctgtcaatgataacgtagctccttttgaccagaatttggacgctagaagctcagccttccaaagaaacagcgacttcaattcgattggacaaccagattttcttgatgttgaaatatcaactatggatgcaccattgaagttgaagcagcaggggtaccttatggaccaacggaagccacagggcggttatgttccccacaatgctggttcgttggatgagttagtgagctcaatgatgaaacaggaaaggagataaggcgaaatcctaatccctgtgtagaatactctttgaagtcgcggcgctgttcttcgtatttgtcttcttatctaattaatctcaagttttgtatttgagtagcaagaattagtctccaatctctctatttagttgctgagtcataagggctttgtttaatctgtatgatgaagaggccttgtcgtccaggccccgacaatgtattaaggagtagttaatcatgtctctttgactacatatgctttggcttccctttagtttaattaattctgcataattagcataaaaaaaa

SEQ ID NO: 16436 - DNA, 751 bp, Malus x domestica
  Predicted polypeptide sequence is orthologous to G1048
ctccacctccgctcttagtccacctttagcctttaggattatcattagattagatatttcaactgcttctttgtttatggaattggacgctgatgttggatttctggatgaaatcgattgggatctttggttagacgacgcctctatttccaatggattggatcatgtctttcagttgccaaatccacccgtcacggcgaccggttcaacgccgctgccgccgtcatcatccacttcgccatcttcaacggtggaggagcctgagcctccttcgaacccatccccggatttgctcggcgcgatcgagaccattttgatgaaagacgactactacgaccaatttttggcagatgcactcgtcaactcgccgctcaccgatgacgccgacgacgatcctatctccaagaaaaggagaaggcagttgagaaacaaggatgcggccgtgagatcaagggagaggagaaagatgtatgtgaaggatctggagattaagagcaagtattttgaagctgaatgcaggagactgggcaatttgctccagtgctgctacgccgagaatcatgctttacgcttgagtttgcagatgaacaatgcatatcgacaaggacatggtggtttggcctcaaagcaggagtctgctgtgctctttttggaactcctgctgttgggttccctgctttggtgcctggacatcatgtgcctccttgctctgcctcgaactctatgaccctgctgctacatcccctgaaaa

SEQ ID NO: 16437 - DNA, 598 bp, Malus x domestica
  Predicted polypeptide sequence is orthologous to G1048
cgttgctgtcgagtccacctttagcctttaggattatcattagattagatatttcaactgcttctttgtttatggaattggacgctgatgttggatttctggatgaaatcgattgggatctttggttagacgacgcctctatttccaatggattggatcatgtctttcagttgccaaatccacccgtcacggcgaccggttcaacgccgctgccgccgtcatcatccacttcgccatcttcaacggtggaggagcctgagcctccttcgaacccatccccggatttgctcggcgcgatcgagaccattttgatgaaagacgacgatttcgacgccaacaaggttcctttggcggaatcgggacccgctaacaacgactactacgaccaatttttggcagatgcactcgtcaactcgccttccactgacggtgattccagcgctttccccgattccgacaaagacaaattcgaccgctcgccgctcaccgatgacgccgacgacgatcctatctccaagaaaaggagaaggcagttgagaaacaaggatgcggccgtgagatcaagggagaggagaaagatgtatgtgaaggatctgga

SEQ ID NO: 16438 - DNA, 678 bp, Malus x domestica
  Predicted polypeptide sequence is orthologous to G1050
gcgacattgtatttgtagtcaacactaacatttttgttttgctgatcgaaatgctttgaaatcaccgcctttaacatttgatcatccattctgcacttgtactgagagccaaagctggccagcagccgctgctagggattttatgatcagatgtgataaaaaagtaggaaacttggatggtttttcgtttgatgaatcgaggttttctgagctttttagctgagctttaatggagggcagtgatgaaactggtagttccaagcaacagcggcctaatccaacatttgggtcgtcgtctttcctggttcctaagccaaacagcaatttagatattcccaatttcaacccctctcaaatgggtttccgtatgagtcctgagagcagtaagagacctgggattcctccttcgcaccctaataatcacaattcgatgcctttttcgaggtctcaatcgggttcttggcagctgggtcaacagaatttcagctcagggtcatcccacgctaggtctatgtctcaacctccctttttctcgcttgattctttgcccccattgagccctttgacgtaccgcgagccctccgctccttctctgtctgaccagaattctgttgatgtttctatgggggagagtgttgttaactctcatgggccttcgcttcgttcgccggttaatga

SEQ ID NO: 16439 - DNA, 599 bp, Malus x domestica
  misc_feature (57)..(57): n is a, c, g, or t
  Predicted polypeptide sequence is orthologous to G1050
gcttttttgggtttgattcgatttgcgatctgggtttttgggtttagagatttctgnattcacatttgaaaaaaaagtaggaaacttgatggtttttcgtttgatggatcgaggtttttagagctttttagctgagctttaatggagggcagtgatgaaactggtagtgccaagcaacagcggcctaatccagcatttgggtcgtcgtctttcttggttcctaagccaaacagcaatttagatattcccaatttcaacccctctcaaatgggtttccgtatgagtcctgagagcagcaagagacctgggattcctccttcgcacccgaataatcacaattcgatgcctttttctaggcctcaatcgggttcttggcagatgggtcaacagaatttgagctcagggtcatcccacactaggtctatgtctcaacctcctttcttctcgcttgattctttgcccccattgagccctttgacgtaccgcgagccctcgcctccttctctgtctgacccgaattctgttgatgtttctatgggggagagtgttgttaactctcatgggccttcgcttcgttccccggttaatgacagcactgc

SEQ ID NO: 16440 - DNA, 622 bp, Malus x domestica
  Predicted polypeptide sequence is orthologous to G1052
taaaactccttcctcccctgttccggagatagatatagccctctcgaaacctagctgttagagttttatttttgtgggggggtaataataaactaaatccccgaacgggtacttgaacccctctcctgcaaggtatagaacaactaagggtactggtcctgctcgctttggttctgctcctgtggtgaccaagaagcaggagcttgagctcaaccagccattgataatcacttttttggttcccaatcgggatggagattctggtccggtgtaggggacaccttattcatgatctaggggtcaaatgtagcctgcgctaagcagggagagctcctctttggttccatctgtccacattcttcccttccatccaggggaattggggcttgattgttccgtgtagtcgattcgctaattaccctccatgaacagagtccatgagctcgggaagagaagtagggccttcggtcaaccaagagaggtccagcccttcctgatcattctcgttgcgttcttctttcgagctgatcagtcagcttctagccacccaaccaatcctgttgatcctgacctacagaaaggggtgaatgaggttctgaaagaaagccctcatccgtgtttc

SEQ ID NO: 16441 - DNA, 585 bp, Malus x domestica
  Predicted polypeptide sequence is orthologous to G1062
gtcgatgatctgagtttcgatggttcgggtttgaactatgattcggatgagtttactgagaacactaaggttgatgacggtgccaagaatggtgggaacagctcgaatgcaaatagcacggttaccggtggaggagggggtcataaggggaagaagaaagggttgcctgccaagaatctgatggctgagaggcgccgccggaagaagctcaatgataggctgtacatgctgagatccgttgttccgaagattagcaaaatggacagggcctcaatccttggggatgcaattgagtacttgaaggaacttctgcagaggatcaacaacctccacaatgaactggagtcaatccctcctggatctgcattgacacctaccggaaatactttccaccctttgacacccactccggctactctgccaaatcgtatcaaggaagaactttgccccagctcattacctagcccaaatggccaagctgcaagggttgaagttaggctgccagaaagacgagcagttaacatccacatgttctgcggccgaaggccaggtctcttgctctcaaccatgaaaactttggataac

SEQ ID NO: 16442 - DNA, 629 bp, Malus x domestica
  misc_feature (66)..(66): n is a, c, g, or t
  Predicted polypeptide sequence is orthologous to G1064
gccacctgcaacatctgctactgccgtggatgcatatgcaagggatccatattatcgctcctattntgattcttcattgtcggacccatacctggctcccaataggagagaggatgttatgtcagggccttattccgttggtggaaggagggagaactacctaattgaggctgatcctgtgcaaaggagagaaaccagcaacagacgaagagacagttaccggattgagactgatcctgtgtataggagagaacccgttcgtcatgtagagagattgtcattgtactcgaggcaagatgctgctgctgctgatgctccattaggttataaccttacagaagcctaccaggtgaccaagccggatcctgtgcatgcaccagtttcctctcgttatgcttttgcaggtccgtcatacaccttccgctaaatgaagttcttgcatcccctccgtctatgcaggccggatcttttcttcgaacttttttcttaaccgaaaaaaaacaagaagaaaaataaaactttgtatcaaatatttaaactttcggatcgaaattaggggacaaagtcttgaacttggtactgtttctggtaattggtactgctgaagggtgacagcattgtctttgaca

SEQ ID NO: 16443 - DNA, 572 bp, Malus x domestica
  misc_feature (451)..(451): n is a, c, g, or t
  Predicted polypeptide sequence is orthologous to G1075, G1076
aaggaaaagagaggaagaagatgaagaacaacaacaaagaggttcagaaaagaaaaataaataaaaattaaacatgagaagtggtactaggtagaaccaacaagaccaaattaagttgcaaaacatgggcgtgatgttaacgatgatagctagtccaggaaatttgctaaccttttatctccaacaaagctcatctcatccagtatgcacttaacctcccacaacgcacgcagaagcagcttcgaatctaaattgattaaggttctaaaagtaaacatcgatgatgatcccacagaaaatcagaatagtggacgaccccctgagttatttccatttccagcccacccatcgattggcaactgaacattctgcatattcaatggcaaattgaagaatggaagccccgaggacgggtcaggaaaagggttgtttccaacactaccaccaccgncgccgccaccacttcccccggatccctgtgggacctgtacttgcaactgttcctcttcatccaaaggcagcctctcataagcaacattagtaaacgatgaggcgatcacaataacgggccc

SEQ ID NO: 16444 - DNA, 662 bp, Malus x domestica
  Predicted polypeptide sequence is orthologous to G1075, G1076
ctctctcctcctccttgcacctctctctcctcaactcgtacccttccctttctctgcacttgatcccctttgttttctattcgttctagggtttgaaattatggggctctcctttctccaaaacccataaaatattgaatcttgctatattaaaatttttacatatattttactatatttttcttgttttctgttctctttagctctctgtgtatggctggcttagacttgggttcagcatctcggtttgttcatcagcagctccaactccctgatctccacctccaaagaccgccggactccgaagatgaccacaccacccccaaccgcaacaatcttttctcctctgaccaccaccaaaatgatgttgataatgacaatcctcatcatcaagggtttgacctggtgaccccaaatcctggttcgggtgattccggcggccgacgctccagaggtcggcccccagggtctagaaacaagcccaaacccccagtgatcataactcgtgagagcgcaaacaccctaagagcacatattttggaggtcagcagtggctgtgatgtgtttgattccgtcggcacttatgcgaggaaaaggcagcgagggatttgtgttttgagtgggagtggtatggtgaccaacgtgagcttgcgtcaaccgtc

SEQ ID NO: 16445 - DNA, 622 bp, Malus x domestica
  Predicted polypeptide sequence is orthologous to G1078
caccagaggagtgtgagttttataggaaaattcattgctcacttccttgcatgggcgatgtgggactcgcccaatgggggaaaaaatcaaaatttcggccgaaattttacacccactttaaacggccataactttgtcaaaactcaacgaaatcaagcaagacaaaaacgaaagttgtagccctcgaagagatgaagagaatggtacctcacacgatgtctgaatcgtagtggtttggccggaaaatgcctcgaaaatcactgaggtcgctgaggtcgtcggaaactgggtaagattcaaatgagtataactttttcaatacgcaacgaaattgagtgaaacaaaacgaaaagttgtagccctcgaagagacaaagagaatggtacctcacacgatgtctgaatcgtagtggtttggccggacaattcctcgaaagtcactgaggtcgctgaggtcgtcggaaactgggtaagattcaaatgaatataactttttcaatacgcaacgaaattgagtgaaacaaaaaggaaagttgtagccctcgaagaaacgaagagaatggtacctcacacgacgtctgactcgttgtggtttggccggaaattgcctcgaaatctactga

SEQ ID NO: 16446 - DNA, 632 bp, Malus x domestica
  Predicted polypeptide sequence is orthologous to G1082
atgtggaaatgtatgctcgaatgtcatagtagccagtgcctagcaattagagaagccagaggtttaggtcctatcggatctggaaaaaagcttaatgatggtcatcttgagaccacattgcagcttgaacatgagcttattaactggactttcagattctctacttggattagtgcgcagaagggatatgtgcgagctttgaacaagtggcttttaaaatgtcttctgtatgaaccggaagaaacaccggatggaatagttcccttttcacctggtagaataggtgcacccccaatttttgtaatatgtaaccaatggtcacaggctttggagaatatatctgaaagagaggtggttgaatcgatgcgtattttcaccaccagtgtgcttcagacttgggaacaagataagattgaaatgcgccaaaggatggtggcaaacaaggatctagagaaacaagttaagaacttggatagaaaggaccaaaaaatacagaaagaaattcaggcattagacaagaaagttttgctagcatcaggggatggtgacggactctcgggttgctgggcagattgtatatcagagtgacactagaaatagtactttacagggtagtctgcaacgcatttttg

SEQ ID NO: 16447 - DNA, 679 bp, Malus x domestica
  Predicted polypeptide sequence is orthologous to G1082
cgttgctgtcgaagataagcttgaaatgcgccagaggatggtggcacagaaggatctagagaaacaagttaaaaacttggatagaaaagaccaaaaaatacataaggaaattcaggcattagacaagaaaattatgctagcgtcaggggacggtgacggtctctcggttgctggacagattgtatatcagagtgacactagaaatattactttacaggctagtctgcaacgcatttttgaggcgatggaaaggttcgctgattgctctacaaaagtgtatgaggagcttttgcaacgtaatgaagaagaaaggcttgctagagcggatgagagagcttcgtagggctctgcggttaaatggagttatgaccatcccttttcagccatctaggtgaaggatttggaagctcaagatctttgagaaaattgcattccttggagaaagcttttcctccactcttcgcctgtaatagctcagtaagccatacttgtgggcctgtggctttacatcgacggtgcaagatatttatctgggttgactatacagttttaatttaatgagacagccagcacagttgattcacaacttacacaagctaagacgaagggcaagcccgaggtaagttatcgccgattataaatcagcttggtccactgcccaacagcagaaatgattcta

SEQ ID NO: 16448 - DNA, 591 bp, Malus x domestica
  Predicted polypeptide sequence is orthologous to G1095
accctcggaaccatgtgggcagctctgtgaacaactcctctctgagggagaagattcagagaaggaaatttgaatccaatcgtcaggatcaaaatatgtgggttgctcgggatgcaattctgatccatattgatagatcgcgagttgccgtctcatttttatttttttttaattcttctctgtctgctttggtcacagtttttggggtgaataatgcggaactgaagtcttgttttacgcgaaacttcttcggcgttttgaaattcgaggcgtgtttcgccataactgaatgggatattctatttggggtttcttcccagaaaatatatatatacaaaagtcccgaaagctgcaatcagagctgcagtcggagctagagacgaggagctaagcgtctaggatgactcacaccgtcagtgttcagtcatcacgtatgatatttcaacctggctgttcctgattgagttctttattcatattatatattaaattttctaggatatccggtttcgccgttgaaggacctgttctagtgttgcaagctaggtcaagtaatcaagctaggttcagtctttcagaatccctctctcc

SEQ ID NO: 16449 - DNA, 468 bp, Malus x domestica
  Predicted polypeptide sequence is orthologous to G1100
ttttttttttttttaaaataaacacatgcaccactcttattcaataacttttttttcgtcaagggctcataaatactgcccgaacttgtataaacgtatgttaaacatttaaaagagggcatatcgtttttcaattataggtcaccaaaatattttgcaataacatttcctttacgtaaatcctcaacaactcctttacgtaaatcctcaacaactccaattaacttgtacgaacgttcatcctttaattaacaggaactccaaagaatgggaaagacggcattctctatatcactgtaaagtggtctatgtatctcgatcaaaattgcctggggccagcattgagcccatggatttgttcagcaacaaaaggatcaatacgaatatcgagagttgaagcataaacctaggctccgaaacacgcctcgtgccgaattcggcacgaggagagaactagtctccagtttt

SEQ ID NO: 16450 - DNA, 579 bp, Malus x domestica
  Predicted polypeptide sequence is orthologous to G1108, G2394
taggcaatgtgtggatttttggaagtcactcttctccttctgatgctcctaaactgtacaactgtattggatatgcaatgccattcatactatgtgcaacaatttgctgctgcctaccttgcatcatttctgtcctcggatttcgagaggatctttctcagactagaggagccaccgtggaatcaattaatgctctcccgacgtacaaattcaagttgaaggaaaacgagagcaatgatgatcaggagggcaacctaggtagtgaatgtggcctcttggctgcagggacagaaaaggagcgtgagatatctggagaagatgcggtttgttgtatttgcttggcaaagtatgcagatgacgatgagctacgggagctaccatgtttacatgtctttcacgtggagtgtgttgacaaatggttgaaaataaatgcatcgtgtcccctttgcaaaagtgaggccggagagagcagcggcgaggccagggactccagccaacaatagggtaagcaagatgagctcagcgatgacgttgtatatgaaagcagagattattctaaattatggaacggttaaaccc

SEQ ID NO: 16451 - DNA, 617 bp, Malus x domestica
  Predicted polypeptide sequence is orthologous to G1108
ttcctctccgtgtgagagatcttctcactttctgtgagttagtgcttccacatccaatgaatcgttcagccgccggccttagcagttgccagggtcggtggcaatccctgtccctattctttttcctgttctcctcctctgttgttcttgattttctgatccatttttcttctatcatccaccccctcttgcttcagttaaccgaccttggctctcgactggaaaatttccttttccgatctctcctttcttattctccccataatctttccacctccatgcatttactcaaacaactttttgtctatcccacttcgcccgatcttcatcccacaattcttttgttctgtaaccttttcgttttaccgtgtttcacgactttctaggaaagtgtgtagagcttcagctcggatggtcacaccacctctttccgtttgtgtgtcagtcttggcactgttgcctatgagaggttctttcccaatggcttccttcccttggtggttccagacttgatgtgtgggatgtttgtttgaggacgttgcaattttctgtttctgttcctggggcttggttgggatttatcttcaacaactgcagggggctcagttcgtggtcgg

SEQ ID NO: 16452 - DNA, 542 bp, Malus x domestica
  Predicted polypeptide sequence is orthologous to G1129
tgaaatatctgcaagatttagtaccagggtgcaacaagatcactggcaaggccggcatgcttgatgaaatcatcaattatgttcagtctcttcaacgacaagtagagttcctgtctatgaaactagctgctgtgaatccgaggcttgacttcaacatcgacgacttgtttgcaaaagagatgtttcctacgtgcgcggccaattttccgacgatggggatgtcatcagaaatgaccaattctgtgtatcttcagttgaatccaatgcaacaattggtttcatcttctgggttggatatggggttaaattccactgatttggcacttcgaagaaccataagcgctccgagttcgatccccgaaccatttcttgacacatcctgtttcactcaagcccaacctacggcaatttgggatgttgatttacagaacattttcaatgtggaatttcaacaaagaagatcatcctttcaatcgcaaccatttataggttccattgaagatagcaatttaaagatggagatgtgaatgaaacgtcactca

SEQ ID NO: 16453 - DNA, 403 bp, Malus x domestica
  Predicted polypeptide sequence is orthologous to G1146
aattttttggccacgtatcacaaatgtggtagccacgtcagtatttaacgcattaattgatggaaaaagctaacggatgtattatattgaaataaaatagtacttgaggtatgaaagtgaaatgttttaaagatgttgtatagggttgtaatagacctcaaacttgaggggttactatgtaatttacccaataaaaaatcatacctagacctctctcccctccgcctcattcctccccaccaaatgcctccgtgtctgtaaccacagatggactaattttctacgttaaataaaatttacaaacaaaaattaacaaatttttaattgataaatgaaatttttttagtttgaacaaaggatcttttttatgctgagagtgtgagagtaaactatgctttacaat

SEQ ID NO: 16454 - DNA, 682 bp, Malus x domestica
  Predicted polypeptide sequence is orthologous to G1146
gatttgtttctcgagtgactctgtgagttaattgcttgctactgctcctgctgctgctgctcagtgagtttaaatggctggttggctgttgtggaattagtgtttaaatcttttggaaattgagtgaaaaaaactagaagggaagtaaagcattgtgtttctgtgcaatctggcgaaagcttcatcgttttgaacgaatgcttctgcaaacatgcctataagaaagaaagagagctcggagcaacaccttgtgatcaaaccccacttgcagaacccagtgaacccagttcagaaggcaccgaaaactgcccaaaatggcaaaggtccaccaccccaggaatcccaaaaagccaaaccccataaccaaacttcacccccaacaaaaaacagaggaagaagaaggggcagaggtggtcggaagtctgatcaaggcgatgtttgtatgaggcctagttcgcggcactgcacggtggctcatctgcctgcctcaccaagcttgggtggtgctgcttctgtagcgaatgctccaaatgggtatggcggcaacttagtttccatggatatggggtttccgacttcaagcaagtcattgagctttgctcctcggcctggttatggacaagttgggatcaagtgtgttgtgaaggccaaccatttctttgcagagttaccagagaacgac

SEQ ID NO: 16455 - DNA, 672 bp, Malus x domestica
  Predicted polypeptide sequence is orthologous to G1146
aagttgcatcgaaaaagatcaacaaagatgtcattaagcagctcgtaaaactttacaaggagtcccacctgggcaagagaatcccagcttatgatggcatgaaaagtatttatacagcagggcccttaccatttgcctcgaaagagtttgtggtaaagttggccgagagagagggttcggctgttgctgctcgttcatttttgagggaccaagagttcaaggtcactctcaagttggctagcaaacccgacctgcatcagctgcaacagtttctacgaagccaacaacatgagtcgcctcaaggcgtacttcaagttctggatgttgttcttagggccacaacttctgaaaagtacactgttgttgggaggtctttttttgacgttgagcttgggcagaaaggtgattttgttgagggtctggaatactggagaggcttttaccagagtctaaggatgactcagtttgggcttgcactcaatatagttgctgaatacagtgaaagagcattcgaattatgaattgatacggacgaatcgattcggtggtaattttggtggtttaagattgtacttttcaaaagtcggcaaaatcagaggattaagatcatacctttgaaattttttgttttgaactggggaggagaacgcagagctgctctctgctgttctt

SEQ ID NO: 16456 - DNA, 596 bp, Malus x domestica
  Predicted polypeptide sequence is orthologous to G1146
ttcggagctgatgtgactcaccctgaaaatggagaagattccagtccccaattgctgctgtcgtagcttcccaggactggcccgaagtgaccaagtatgctggattagtttgtgctcaagctcacagacaagaactcatacaagatttgtataaaacatggcaagaccctgttcgtggcacggtcagtggcggcatgatccgggatcttctggtttcctttaggaaagcaacaggacagaagccactaaggattatattttacagggatggcgtaagtgaaggtcaattttatcaagtcttactatacgagctcgatgcaatccggaaggcatgcgcttctctggaaccaaactatcaaccaccagtgactttcattgtagttcaaaaacggcatcacacacgaatatttgctaataaccatagggacaggagcagcgtagacaagagtgggaacatattacctggcaccgtggttgatactaagatttgtcatccaaccgaacatgatttttatctctgcagtcatgctggtattcaggggacaagtcgcccagctcactaccatgttctctgggatgagaataactttactgct

SEQ ID NO: 16457 - DNA, 419 bp, Malus x domestica
  Predicted polypeptide sequence is orthologous to G1146
ggaatcaggaaaaaacaatttcagaaaaccaatgttcgaatcccactcatgttcgtaccaatggaaactgagcgagtgcaccttggacacctgataaacatacgattacaaagttagaaaacattaagttctcttcaaattggcgtcgtacaagtgcaaaagccagagtaaaaattgaaattaatgtctgcttacgtgtagcataggttgttcgttagcatctgcaatgcatctggggttgttctcatcatacaggacactatgatgattgcaccccatattttgtaaaagaaatgtcacctttttatgtatattattgtgctcttcaattatgtaaattgtaaagcctattctaacttgttttatgcaactattttcgtaaaattttgtaattataaaaaaaaaaaaaaaaaatgcgt

SEQ ID NO: 16458 - DNA, 598 bp, Malus x domestica
  Predicted polypeptide sequence is orthologous to G1146
cacgaggcattgagtttgtcaatgagctgctcaaccgagacatttcatctagaccattgtctgatgctgatcgtgtgaagataaagaaggctctgcgaggaataaaggttgaagttacgcaccgtggaaatatgcgcagaaaatatcgcatatctggtttgacatcgcaggcaacaagagaactgaccttcccactcgatcagcaaaatactatgaaatcagttgttgagtactttcatgaaacctatggcttcatcattaagcatacccagctgccttgcctacaagtgggaaatcaacaaaggtcaaattatttgcccatggaggtttgtaaaattgttgagggtcagaggtactcccggaggctgaatgagagacagattactgctttgcttaaagtgacctgtcagcgtccttacgaaagggaacatgacattatgcagacagttcgtcaaaatgcttaccacgaagatccttatgctcaggagtttgggattaaaatcagcgagaatctcactttggttgaagctcgcatccttcctgcgcccaggcttaaatatcatgatacaggcagagaaaaggattgcctgcctcgagg

SEQ ID NO: 16459 - DNA, 660 bp, Malus x domestica
  Predicted polypeptide sequence is orthologous to G1146
tacgagggtttttcattagttcccttgtaatatatccacctcaaaatattctggttcttaactttgaaccaaaatccatttccttcacaagacttgtttcataagcccccataggacacaaaacttacaaccaaaaccatcgcggatgagatgagcgatttaaacgtccgtcttccagacgataaccaaaatataagattaaagtcttgtgcaacttttagttcatacgaccttgacgaaacacaactactagaaaccgccgccagcgacaaaacggacctctacaaaacactagtcgaaaccaatgccaccaaagaccaaacggagctcaagactgattcagcagtagaacataacttctttcacattttcttttatctcaggtagggcacggaaccgcacaccaccagaacccccagctgtagatccggtagtagaacctccatctgagtactcgccttcaatgtagtatcttgcacggaaggcagccaagtgagcatagtaagcagcctcgtgccgaattcggcacgaggtctctctctaaaacttcatctctctctctctctctctctctccccctaaatctgccgatctactctgcgccgaaaccctagaaccgaaaatgcgtgagatccttcacatccagggaggccaatgcgg

SEQ ID NO: 16460 - DNA, 713 bp, Malus x domestica
  Predicted polypeptide sequence is orthologous to G1146
cgaattccgttgctgtcgacgaaacatgttttcagaatgagtaaacaatacttggcaaatgttgctttgaagataaatgtgaaggttggcggaaggaacacagtgcttgttgatgcactgtcaagacgtattcctttagtcagtgaccgtcctactataatttttggtgctgatgttacccatcctcatcctggggaggattcaagcccctcaattgcagctgttgtggcctcacaagactggccagaaatcaccaagtacgctggcttggtctgtgcgcaagctcatcgccaggagcttatccaagatctcttcaaaacttggcaggatcctcagaggggcactgtaactggtggaatgattaaggaactgctaatttcgttccgtagagcaacaggacagaagccacagcgcatcatattttacagggacggtgtcagcgaggggcagttctaccaagttctactatacgagcttgatgcgattcgtaaggcttgtgcttccttggagccaaactatcagccacctgtgacttttgttgtggttcagaaacgtcaccacacaaggctgtttgccaacaatcatagtgaccgtaatgcagttgacaggagtggaaatatcttacctggcacggttgtggactccaaaatctgtcatcccacagagtttgacttttacctctgcagccatgctgggattcagggtacaagccg

SEQ ID NO: 16461 - DNA, 455 bp, Malus x domestica
  Predicted polypeptide sequence is orthologous to G1150
atcgcccaccctctgctttttattctaacacaggaagcaacagaagcatcatcgtcatcctcagcaagaagagattaaagagtcaaacacctcaacccttgttcagttccttcccaattttctctctctacaactttctctctctaaaatccatctctttcctcgtggaatcgcaaactttcagagccgcgcctctttgcaatcccaaatctttttcattaatttattacggttttgtccccaagtcttcgctttttttttttattttttattttatacccattgccataaaaaaccctagcctcactcgctgcccgaaaccccaattcgcgaagttcctctcccgtctggaaattggtattttgttcaaaaccctagctttgttttctgctgcaatttatggtgattttggtgttagaatcgatgatttggaatgcgaatttgttgcagtacca

SEQ ID NO: 16462 - DNA, 549 bp, Malus x domestica
  misc_feature (541)..(541): n is a, c, g, or t
  Predicted polypeptide sequence is orthologous to G1181, G1850
ttttttttttacctcaaaacactcctgttaatttttgtttctcgatcattttcaattcatttcatacaacggtagtaaattggaaaaagagtacaaaaagttaaaaaaataaatatgtacggggcaccacctataaaaacctcagcatttgggaccgtcttctttccgtcctctggcgcgcttcatatggtactatctcattcccgcccatacgacaccgtcccgggtttcggttcttatcttttccatccacgtggcgccatcccagttattatctcgcacgtgcgcacattcctccccgtgcgttgctgtccacgcttccattatcggcttccataaacaacaatcgcctacgtcatctgatcattttcaatcactttccgagctccagccacgtggcgtcacaatcgcgcttcaagctcccatccgacggctcttgcttcgccccctcggagccttcccgatgttgttcctcttcgtcttcgtctctcctcacgcgcttcaccccgatcgaaaccccgaacaacctcggcctcatctnctcctctt

SEQ ID NO: 16463 - DNA, 554 bp, Malus x domestica
  Predicted polypeptide sequence is orthologous to G1181, G1850
ttcctctctctcgctctctctctatctctctctcatcgtcttccaaatttccatgtcaattttcctctaacgttagaggtgcggctttcgatatggctccgacgccggtggagccgaccggcgagtccacgtccagcgagtcgtcgcagcgagctcttccgactccgtttttgaccaagacgtatcagctcgtcgacgatccctcaatcgacgacgtcatctcatggagcgacgacggatccagcttcgtcgtctggaaccccaccgtcttcgccagagatttgctccccaagtacttcaagcacaacaacttctccagcttcgtacggcagctcaacacctacggatttcggaaggttgtgccggaccgatgggaattcttgaacgatagctttcggagaggcgagaagcggcttctctgcgaaatacaacgccggaaaatcaaccctccggcgccgccggtggcgtcggtttgggcggttccgactgctaaaccgaatatttccccggcgaactcgggcgacaagacagtgaaatcttcgaattcgtcgcca

SEQ ID NO: 16464 - DNA, 421 bp, Malus x domestica
  Predicted polypeptide sequence is orthologous to G1190
ggagatgtggcaccggcagcatagttactagtgttgtggatggggatcagtggcttaaggtttgatatacttcatcaactttgagtcttgagctgaagagaaaaatttacaaatatagtaagaatatccgcatgcagttatgaacatatactcacggatcaatatcctatatttcatacaactgtttgtaaacaaaacaattccttaaataaacaaaaggttcctctgtggcttatatattaagcaccagaggtatctgagttagaagaagtactattggttatctgtggtgctcttcccctatatcatcctaataaaggacagcttcttctttactgatgtgatcatcatgtatacgttatacgtactgatgtaatattgcacttatataattagtgatatctacttaattattatgagt

SEQ ID NO: 16465 - DNA, 757 bp, Malus x domestica
  Predicted polypeptide sequence is orthologous to G1190
cgttgctgtcggacacctatcctgcaaagtgtgatgatagccttgaaccagattcaggatggtacactccattacgctcttgtgtcgtagttccagacccaaagctaaaaaagtcagctttgaaatccatccctcaatggccagagcggttgcatgttgcaccggagcgtatttctgatgtgcatggcggaagtgctagtgctttcaagcatgatgacagcaagtggagggtacgattgaagcattacaaaaagttgctcccagcaattggaacagataagatcagaaatgttatggacatgaatacggtatatggaggttttgccgcagccacgattgattgtcccttgtgggtcatgaatgtggtctcttcctatgctgtaaatacactacctgtggtctatgatcgaggccttatcggaacttaccatgattggtgtgaggcgttttctacttatcctcgtacttacgatcttctacatcttgatggcctctttactgcagaaagccacagatgcgaaatgaaaaatgtgctcttagagatggaccgaatcctgcgccctaatggctacgcaatagttcgagaatccagctactttgtggacgctgttgcgactattgccaaagggatgagatggggatgccgcaaagaagacactgagtatggcgttgagaaggagaaaatactgatatgccagaaaaaactctggtattcatcgaaccggactttcagatgatggccatccatagaaaaacc

SEQ ID NO: 16466 - DNA, 568 bp, Malus x domestica
  Predicted polypeptide sequence is orthologous to G1225
ttttttttttcgaaccaatcatatgctactattgctatgtgaaaatgttaaaacaatgacacagtaacgtcacaattacatgtaagtttacctcgttcccgactaaaaacttagtttagtgacccaagtggacagtggcccctacaattaacaaagacagtgacccatgtgtacttgtgtatcacaatgcttaaagaaaaagggaaagtgatgcatgaacatctttcacttttcaccccagcaaataaatcataaatttaattttgagatgaaataagtcatgaaatgaaccttgacaaatgtatcatcagctatcaacaactacttgaagcctaagagcaagccaaattttcagagatataaacaaccacttggcaatctgttttaagcccctattaacctaataaacttgaaacttcacaattctttgtttctatgtacacaatagacatggaaatgcaaacgtcaaatgcaatgagttatgatggtaaattagaggatatagagcattagggtgtggccgggaaagccggcgatatcgatgaactctatctgagatcaatatcga

SEQ ID NO: 16467 - DNA, 473 bp, Malus x domestica
  Predicted polypeptide sequence is orthologous to G1242
acaggatcattaagaacattgaaagaggtgaggccagaatttcccgcaaagatgagatcatgaaagccattgggaagaagttggatcgttacaagaatccatggctggaattgaaaatccagtatggtcaaaacaaggggaagttgtacaatgaagaatgcgatcgtttcatgatatgcatggttcacaaacttgggtatgggaattgggacgaattgaaggcagaattccgcacatcacccttgtttcgttttgattggtttgtgaagtctcgcacaactcaggaacttgctaggaggtgtgatacattaattagattggtggagaaagagaaccatgaatacgatgagagggagagacaggcccgcaaagagaagaagcttgctaagagcatgacaccatcaaagcgggccttgggtagacagccaactgagagcccaaatactgggaagaagaagaagcaattaaccatg

SEQ ID NO: 16468 - DNA, 616 bp, Malus x domestica
  Predicted polypeptide sequence is orthologous to G1242
cacgaggcattgaaagaggtgaggctagaatttcccgcaaagatgagatcatgaaagccattgggaagaagttggatcgttacaagaatccatggctggaattgaagatccagtatggtcagaacaaggggaagttgtacaatgaagaatgcgatcgtttcatgttatgcatggttcacaaacttgggtatgggaattgggacgagttgaaggcagaattccgcacatcacccttgtttcgttttgattggtttgtgaagtctcgcacaactcaggaactcgctaggaggtgtgatacaataattaggctggtggagaaagagaaccaagaatacgacgagagggagaggcaggcccgcaaagagaagaagcttgctaagagcatggcgccatcgaagcgggccatgggcaggcagccgactgagagcccaaattccggaaagaagaggaagcaactaaccatggatgattatgtcaactcgggaaaaaagaggaaatgatcaaacataaacatcctgaatgcttttgggtgctcgagacatcggatgtttggacatcgaaaagcacggagtattagagtttaggctttttgtctttatattttttgccccgatgg

SEQ ID NO: 16469 - DNA, 605 bp, Malus x domestica
  misc_feature (506)..(506): n is a, c, g, or t
  misc_feature (524)..(524): n is a, c, g, or t
  Predicted polypeptide sequence is orthologous to G1246
agagaggagccgtggtggtccctcccggaccgcctggatcccacgagtgaatagaaagttggatctacattggatctcacctgaatcgccccatctatcctcctgagtagaagtttggtttcaaaccccggttcgaacaggagaagtacgccatgctaatgtgccttggatgatccacatctcagggtcaggcgctgatgagcacattgaactatccatgtggctgagagccctcacagcccaggcacaacgacgcaattatcaggggcgcgctctaccactgagctaatagcccgccgtgcgggcctcccgctgggggcccgctatgccaaaagcgagagaaaccccatccctctctttccttttttacgcccccacgtcgccacacgggagggacatggggacgtaaaaaaggggatcctatcaacttgttccgacctaggataataagctcatgagcttaagtcttacttcaccgtcgagaaacgaaagaagacttccatctncaagtttaactcagacgnagctcgcttctttttgggtgtgaagcagtgtcaaaccaaaatacccaacaagcattagctcttcctgaaaaggaggtgatc

SEQ ID NO: 16470 - DNA, 392 bp, Malus x domestica
  Predicted polypeptide sequence is orthologous to G1255
tgaagaagctgatccggtaccaagtccgaaaactcaatgccgaaaaccgaccccgaatgaagggtcgattcgtgaagagaagttgaattaacatgcgttttaaacgtctggtttctatctgacatgcatccggatgtttggtgttctgagttagatgtctagtgcatccggatgtttttgttagtttccctaatttctttcctgctttgcttgtccatcaagttactgggaagagggaacatgataagtagtatatgcttttttgcataaaaatatatgcacaatcatacacaaaaagatgatacatatgtgagaatcaattacaatgtgacattaattaacgtgtatatatattgcacagttttatgtaaaaaaaaaaaaaaaaaatgctg

SEQ ID NO: 16471 - DNA, 717 bp, Malus x domestica
  Predicted polypeptide sequence is orthologous to G1255
aaaaatatttattttattaattaaaggatgtacacgctgcatgcatgtatacacaaactcaagtttactacaaggtaaacttatgggccgagccaccggtggacgttcatttggcaagcacgggaaaagcagatccggcaaaggatgatctcttgacaaacctccctttcattcttggccttttctcggcattcagctttcgaacttcgtaccttattttcttcgagaacagccttgttctccgcttttctctgtatcttgacaccctcgcctccctccctccgtccaccattgccggatgtaccccgattccgttcaaatctccgtaagggtaatgaagtccaggtccacatacacccatgtagtcaggcaaaaattcggagtcgaaatccggcgtcgtatgccttatcctcttcaatccccccaattgcttcgcttccaccgctgccgttacactaaaatggcaactttacatttacacagcgccctagctaacccgacgccgttcaaatccacaaacacccagatttcaactcggcgagagccacccaggcgccgagccaactcggtcaggtgcggcgaggcaactcaggtcaccggcgagacccaccgagtcacggtgaagaacgggaacgattctctggacatatgccgagtactgaacggaatgtggcagacgagcggtggctggggcagaatcgaccgagacgacgccgt

SEQ ID NO: 16472 - DNA, 670 bp, Malus x domestica
  Predicted polypeptide sequence is orthologous to G1272
gagatgttgttcctttgcatgtggaagcagataacattcctgaacctgttaagaaaaaacctgctcgggtccctattgctaggcgtggccttggaaccaagggaacaaaaatacccttggtcacaaatcacttcaaagtgaatgttactaatattgagggttacttgcttccattatagtgtttctgtcgcttatgaagatgggcgtccgcttgacggcaagggtgctggaagaagaataattgaaagggtgcatgagacataccactcggagttaggtggaaaggactttgcctatgatggggagaagagcctgtttactgttggatcccttccgcgcaacaaacttgaattcgccgttgttttggaggatgtgccatcaagcaggaacaatggaaactgtgaacctgatggtcctgggagtccaaatgagagtgaccgaaagagattacggcgtccaaatcgctccaaaacatttaatgtggagatcagctatgctgcaaaaattcccatgaaagcaattggagatgctcttcgtggtcaagaatcagagaattctcaagaagctttgagagtcctggatatcatattaagacagcatgcatcgaagcaaggatgcctcctagttcgccaatcattcttccataatgatccaaaaaatttgcggatgt

SEQ ID NO: 16473 - DNA, 681 bp, Malus x domestica
  Predicted polypeptide sequence is orthologous to G1272
tgctaggcgtggccaaggaaccaagggaacaaaaatacctttggtcacaaatcacttcaaagtgaacgttactaatattgagggttacttcttccattatagtgtttctgttgcttatgaagatggccgtccccttgatggaaagggtgctggaagaagaataattgaaagggtgcatgagacctatcagtctgagttaggtggaaaggactttgcctatgatggagagaagagcctgtttactgtgggttccctaccacgcaacaaacttgaatttgccgtagttttggaggatgtgccatcaagcaggaacaatggaaccagtgaacctgatggtcctgggagtccaaatgagagtgaccgaaagagattacggcgtccaaatcgctccaaaacattcaatgtggagattagctatgctgcaaaaattcccatgaaagcaattggagatgctctgcgtgggcaagaatcggagaattctcaagaagctttgagagttctggatatcatactaagacaacatgcatcgaagcaaggatgcctcctagttcgccagtcattcttccataacgatccaaaaaattttgcggatgttggaagcggtgttcttggatgtagaggattccattcaagttttaggaccacccaaggtggcttgtctttgaatattgatgtatcgac

SEQ ID NO: 16474 - DNA, 702 bp, Malus x domestica
  Predicted polypeptide sequence is orthologous to G1272
ctttactcaagtggaaggccgtgttcttccagccccaaagcttaaagtgggtaacggagatgatttcttccctcgaaatgggcgctggaatttcaacaacaagacacttgtgaagccaactaagatagaaaagtgggctgttgtcaacttctccgcacgctgtgatctaaaagcccttgtccgcgatctaatcaaatgtggtgatatgaaaggaattaaaatcgaggctccatttgatgtgtttgaagagaatccccagtctaggcgtgccccacctttggttagagttgagaggatgtttgaggatatacagtccaaacttcctggacaaccacagtttcttctctgtttgctgccggagaggaaaaattctgctttatatggtccatggaagcggaagaatcttgctgagtatggtattgtgacacagtgcattgctcccacgagggtcaatgatcaataccttacaaatgtcctgttaaaaatcaatgcaaagcttggtggtttaaattcattgttggcagttgaatattctccttctatccctgtggtttccaaggctcccactatcatccttgggatggatgtgtcccatggttcacctgggcagtctgatgtaccttcaattgccgcggtggtcagctccaggcagtggcccctgatatctcgctacagggcatctgttcgaacacaatcccacaa

SEQ ID NO: 16475 - DNA, 400 bp, Malus x domestica
  Predicted polypeptide sequence is orthologous to G1273
cctaattctggactcgtaaagaatctaatgaatgaagatgacttgagcgcctcatatgcaattgattctctggtatgaatattttcttgattactatatattatgatttgttgccaatattctttatcttcttctattcgatttttaactggttcttagggaaaaattgttttagtgtagagcggttagtaaatctttatcattgtagttgtattatttttttcaaaaaatgtaaaggcagagcaagatgaacagattggctctgtactgcctgcccaggtggaatacagaaaatgataggcatgcaaaagttgtgtcaaacttcctttattccaaaacgctctcaatatcacatagcattctgccacttgacatttaacagtaaaaaaattatttggac

SEQ ID NO: 16476 - DNA, 616 bp, Malus x domestica
  Predicted polypeptide sequence is orthologous to G1289
aaaagatttgccggttattgaatgggggaggcatgtaagggttgttttagatgttggttgtggtgttgctagctttggtggctatttgctggataaaaatgttattaccatgtcatttgccccgaaagatgaacatgaagctcagatacagtttgctcttgaaagggggattcctgctactctctcagtgattggaacgcaaaggctgacatttccgaacgatgcatttgatttaattcattgtgcaaggtgtcgggttcactgggatgccgatggagggaaaccactactggagctcaacagggttcttcggcctgggggttttttcgtatggtcagctacaccagtttatcgcgacaatgaaagagatacaagtgtatggaaatcaatggaggctctgacaaaatcaatgtgctgggacgttgttgctaagactgtcgattcaactggaattgggcttgtaatatatcagaagcctatctcctttgcccgatatttcaaacgcaaagaaaacaatccacctgtttgtggtcctaaagagaggaaagtaggtgcatggtatgcgcctctcactgcttgtcttaccccactacctcgctatggctggcccctgccc

SEQ ID NO: 16477 - DNA, 598 bp, Malus x domestica
  Predicted polypeptide sequence is orthologous to G1324, G2893
tttgtttaaactcatcaaaagcttgcccttctttttatgattgagagctggtatgtcgactaagactaaaaccctaagtagtagttctggagaagacgatggcgagcttaggagagggccatggactcttgaagaagactctcttcttattcagtacatagctcgtcacggcgaaggccgatggaacttgctagccaaacgttcaggattaaggagaactggcaaaagttgcagattgagatggttgaattatctgaaacccgacgttaagcgaggaaatcttagtccggaagaacagctcttgattcttgacctccactcaaaaatgggaaacaggtggtcgaaaatcgcgcaatatttaccgggaagaacagacaatgaaatcaagaactactggagaacacgggtgcagaaacaagcccggcatctccgaatcgacacgagcagcgtagagtttcaaaacatgataaggtgctattggatgccaaggttgcagcagaagataggaggagaaatatcgacttcttcagctgtgttaaaccaaaaccataccatttcgcagcctctcgaacagaacaccttcccacattttacagcc

SEQ ID NO: 16478 - DNA, 644 bp, Malus x domestica
  misc_feature (17)..(17): n is a, c, g, or t
  misc_feature (25)..(25): n is a, c, g, or t
  misc_feature (27)..(27): n is a, c, g, or t
  Predicted polypeptide sequence is orthologous to G1341
ctcctgcaaatcccggnattgcagnanaaaacccagttctccaaaaagccgaaccggaaacgaggaaggaaacgccatgaaagcttatctccaaagctttcagttttttttttctctcacagtaataatcatcacataaatccaaatggtgataagattagattagattcgattacagtgtaacgttctccagaggctatcgtgtcaagaaatcgccataaagctatgcccttttccttcagcaacctccatttcttcctcccttaaaagctctctcactttttggtttttccttcagtctcaatcgacccctttcggtttctgctgattctgtctctttcccgagaaaaacccagaaaggaaaacccgtttcagaatgctgccaaggctgaacggtggtgtttggatggacgacagggaggacagagactctgtttcctggactagaacctccgccaccgccaccgccggcaacaccgagaacaaggacgagatgggttcttctctgtctaccttcaagtcgatgctggaggttgaagacgactggtacatggcggcgaataacagcatccagggccattcagatgtcggagacatcagcttctcgccgagctttgccgacccagaagcttgctgctcaaccc

SEQ ID NO: 16479 - DNA, 683 bp, Malus x domestica
  Predicted polypeptide sequence is orthologous to G1380
ccaatcaatatctctccgacacccaattgtttctatgaccatcagactctaaaaagcccgattcttggccatgaggaggggcagaggagcagccacgagagccgcagcgccgccggccgaacccaccggatccagacgcagtattggcaaagaggtccggtaccgaggggtgcggagaagaccgtggggtcggtttgcagccgagatccgggacccgtggaagaagacccgggtttggctcggcaccttcgactcggccgaagacgccgcccgagcttacgatgccgccgctcggatcctccgcggccccaaggccaagactaacttcccgatctcatgtgcttacccgcccttttacaacaaccctaccgacccagctatcgaggcaaagcttttcgggtcgggttacggatttcaggacaatccggttgtagatcctcagagacccgcatccagcagcctgagctccaccgtggagtcgttcagtgggccccggccgccgcctcaatttacgacgatggctgccgagttgtcgcggcctaaacgacagccgaggaccccgccggtggttcccgaggactgccacagcgactgcgactcgtcgtcatcggtggttgaggacgacggggatttcgttgcgtcgtcgtcgtttcgcaaggccccgctgcccttcgatcttaatt

SEQ ID NO: 16480 - DNA, 554 bp, Malus x domestica
  Predicted polypeptide sequence is orthologous to G1380
aattccagatgcggcgaggaggcagagccactgcggctgctgcagcagcagcaggagtccaattatgcaagcccaagacggcggtggccgcggcggtacaggaaattagattccggggcgtgcggaagcgaccgtggggccgattcgccgccgagatcagagacccgtggaagaagactcgggtctggctcggcaccttcgactcggccgaggacgcggcccgggcatatgacgccgccgctcggtccctccgggggcccaaggccaagactaatttccctatccccgccgaatacgacaacaaccaccacctacctcctccgtcccatctttctctctacccagacgacacggtttgcgatgtcgtccaggccagccggcccacctccagcagtctcagcagcaccgtcgagtccttcagtgggccccgcccccggcctaggcccacatccaacccccaaccgcagcggagaacggtgctcccggttttccccgaggactgccacagcgactggaactcctcgtcatctgttgttgacgacggccaagattgc

SEQ ID NO: 16481 - DNA, 761 bp, Malus x domestica
  Predicted polypeptide sequence is orthologous to G1380
aaaaaccaaaaaaatcattattatttatatattttttgtgtagaagggaaggtggtgctggtgccatccagttcttctcccacccatccctctaagcaaaccttcccccatatctctctctctctctctcttctcttcctatctctgcaaaacccatctttcaattttcccaatccaaatatctcaaacacccaattctttctatgaccatcagactctaaaaagcccgattcttggccatgaggaggggaagaggagccgctacgagacccgcagcgccgccggccgaacccaccggatccagaccctgtattggaaaagaggtccggtaccgaggggttcggaaaagaccgtggggccggtttgctgccgagatccgtgacccgtggaagaagacccgggtctggctcggcaccttcgactcagctgaagacgccgcccgagcctacgatgccgccgctcgcatccttcgcggccccaaggccaagaccaacttccagatctcatgtgcttaccctaccttttacaacaaccctaccgacccggctatcgaggctaagctttttgggtcgggttacgggtttcaggaccatccggctgtagatccgcagagacccgcatccagtagcctgagctccaccgtggagtcgttcagtgggccccgcccgccgcttcaatcaacgacggtcgctgcccgaatttgaccccgccgaaaacaacagcccaaggacccccccccgtggttccccaaagactgccac

SEQ ID NO: 16482 - DNA, 556 bp, Malus x domestica
  Predicted polypeptide sequence is orthologous to G1384
tgaaacgccagatgggtctgaacttctcgcatccggctggcacataagtgtggagaagttaaaatccaagttgctatcttctagttgatgtgtgacacaaaggttttactttctttgtgggtaaatcacgacagattgaagccatcacgacagattgtcattttgttgctctaccaagaagagtacaaactgcggcgggatggatggcttcatgtaatgtggtctctcctctatgatttcctccctttccccgaaattcctttttgttcatgtacatgtttgatagtaaaagatagccggagtcggactggtaaggaagctgctgttagacgaggaaaagctaggaaacccggaaacctggaaacgtgtatttatatagctaggaagaagggctctcataatagagaatgtcgttggttgctgctggatgggtttcctctacttaaatgttgtttcgtatttagtcctgcggtggtttgtggtcgccgacttgaaattccgaacaaatattgttacttggctactgtttgtgcaaaaaaaaaaaaaaaaaatcggt

SEQ ID NO: 16483 - DNA, 514 bp, Malus x domestica
  Predicted polypeptide sequence is orthologous to G1411, G2509
aagcatgggaagaggtcctttcctggtgatgaatcagagaagaaagaggaggatcatcaaatgatcttcgatccgttttgctcatctgctcgatctcaacatgagatgtctgccatggtctcagctctagctcaagttcttggaagcaataacagccagaccccggctgttcaagagccggtggagccgccactgatcacgccccagtccagcgccatggaattgcatgatggtcaatctcctcagcaggctcaagatcaaggtttaatattgatcagtcgtactattgaccatgagtatttattaatttccaatttttaattgatttatttctgctgtgtaaaattaaatattcatatgacatcgatccagtttcagtttatacgctgtgacagttttttacctgtgaaagtaagcatgagcatgaagttgtgtaatgattttattctcaacaggtgccctattgaaatcctctatattgttccgtttccaaaaaaagaaaaaaaaaatcggt

SEQ ID NO: 16484 - DNA, 631 bp, Malus x domestica
  misc_feature (562)..(562): n is a, c, g, or t
  misc_feature (572)..(572): n is a, c, g, or t
  misc_feature (581)..(581): n is a, c, g, or t
  misc_feature (605)..(605): n is a, c, g, or t
  misc_feature (610)..(610): n is a, c, g, or t
  Predicted polypeptide sequence is orthologous to G1411, G2509
cacaggctcctttctctctctctctctctctctctcgcatctgatcgatctatgtcttgaatcttgatgtcctaatcttaagacaaacgaagaaatttacagaggcctctagctggctacaagctaagatatcacaacaagttggagctcaggattaaaggtggatcggaggcatggaaaacgcccgcttccttcagaagcatcagaggagaaagagagggaggatcctccccaccaccaccatgatttctcttctaactacgaatcttcctggacggaagctgacatgtcagccatggtttctgctctcactcaagttattggaaccaccgaagggcatgctgccgtgcaaccaaaccctacatccatctcagactcatcactcctaatcaaacaagaacccgatcgctctgaaccggttcaagatcaagagaccgtaaggaggcgacactatagaggagtgagacaaagaccttggggcaaatgggcagctgaaatacgtgaccccaagaaagcagccagagtttggcttgggacttttgagaccgccgaaaatgctgcnattggctacnaatacgcanctctcagggtcaaaggcacaaaanccaancctcactttcccgaacgaatt

SEQ ID NO: 16485 - DNA, 573 bp, Malus x domestica
  Predicted polypeptide sequence is orthologous to G1425
ccaggggtcttaacaattggaggatgtgcaaatccgaacggcccaatatgaaggtcactacgacccaccacaacactctgcacccatctcctgcaagctctcatctcgaccaggcccatcgcagccatgccagaggaaacatctgagagtggatgtgcagagaaatttataccctctctgacatagcaaggaagctccccaagtttctctttcaacccacataccacgggccagcctagggccggcatcaattccactcccgttgaaggaagattttgtgaaaacatgttcttttaagcaacatcaataagcatgcaattaacaattaaaggcggaatcatgctagcatgcacttaaaaacaaaacattaaccatgaaatttaaagcctagtagattggtgaaccaaaactcaactcaaaacaaagtgagttgaaattgtatacctttgtagattcctctttgtatttaaacaaaggctaatcacccaagagatagggccttcattccttgcatcttagatccatgcatttggatggatctacaccaaggagagcatggatgataaatgagtg

SEQ ID NO: 16486 - DNA, 444 bp, Malus x domestica
  Predicted polypeptide sequence is orthologous to G1444
ttttccattttattaatagagtttatttagtttgacaacaacaaaaaaagggcggaagctctgaaggtacattgaatataaatcaacataaaacttcttattgggggggtcggaagttgacgccacaattttaactaacataaccgccacaactacggggaaacgtaaacatgaaaaaacccttggctctctcgggccgcaggaacaattcccagccgaaatcttgctagtctcgtaggagcggccttcagttgaaacagctcaacgggcgttggtttcggaacttgcaatcatgaatgttgttaaacaccctttgcagtaaacacaacgggaaaggaagggggcgaaggaaaaaattagctgaatggacatgaaccggacaagcacgaaaaaggcccaagaagaaggggggttatattcaaaaagcgtcatgaaagctcgagg

SEQ ID NO: 16487 - DNA, 548 bp, Malus x domestica
  Predicted polypeptide sequence is orthologous to G1446
agaggacttggatccacaacaaaagagagaggcaacaagacaccaaatttttgtgagttaaaatgtgtgtaaacggctcacggatgtgatgtctgcaaagtataaacacaagcaaagcgtgtcagacccacagatccgagcataagaaaggtgactcggatcgagtggaaatcccagaaaatagggctcaagctgcaaatgtactcgaccaaaaatagcaaagcaaatcgctaagtcaacgcgacctgggatcgaaaagggaaaataccccaaatcggcaaaggaaacgtgatgacaaaaccattagcttacactgaagaatggccgcttagcaaaatagagagattctgtttttctgcagatttgtcaggttctgctgctggcatttcagattctgcagtaatctgcactgcaggcagattctgttcagtacagtttgcacgattgtcataactttttccactccgtaaagtccgaacaacattgcagtcttcatgtcctcttggattaggcactgtttgactaggaaatttgcctttttctctgtc

SEQ ID NO: 16488 - DNA, 650 bp, Malus x domestica
  Predicted polypeptide sequence is orthologous to G1451
ccgtggagacccactaaacagaaattttgttaaggtttataagtcagggtcctttggaaggtctctggacattaccaagttcagcagctatcaagagctacgtaacgagcttgctcgtttgtttggccttgaaggtgaattggacgaccctgtgagatcaggctggcagcttgtatttgttgaccgggagaacgatgttcttctcctcggggatgacccctgtccggagtttgtaaatagcgtgtggtgtatcaaaatactctcaccacaggaagtgcagcaaatgggaaaacgaggcctagaacttctgaagtcagtcccaaatcagaggcccccaaacaatatttgcgacgactatggaagccggcaggactcaagaaacttgagcagcgggataacgtccgtggggtcactcgagtattgaacaactttaaccggttaagataccattctctcttctgtaatattatttgcaacccctccaactcttttaaagagttggaagggcagcctaatactttagctttaaagcctagtttatatataagccaatactgtaattaaatggtacgtattttttttcagtatttccttctatcgaaatacgttcaacgttgtattaggagattaaaaaaaaaaaaaaaaaatgc

SEQ ID NO: 16489 - DNA, 620 bp, Malus x domestica
  Predicted polypeptide sequence is orthologous to G1451
attcatcatctcttatgctgcataatgggattccaaacctgagaaatattggcaatggaaatgattcagtgtccgtgccctttggtgcttccaattatgccagtggcacaggcaatgattttccactaaattcggacatgactacatcaagttgtgtagatgaatcaggtttcttgcagtcttcagaaaatgtggactaagtaaatccaactggaacctttgtgaaggttcacaagtcagggtcctttgggaggtcactggatatttctaaattcagcagctatgatgatctgcgcagtgagctcgcacgtatgtttggccttgaaggccaactgaaggaccctcagagatcaggctggcagcttgtatttgttgacagggagaatgatgttcttctccttggtgacgacccttggcaggagtttgtgaacaatgtgtattacatcaagatactctcgcctctggaagtgcaacaaatgggaaaggaaggcctcaacagtgtggcttctgtcccaaacaataagctttccaatggtagcaacaccactgttgactacgtgggtcgacaggacttgagaaactcaaggaatgggattgcatctttgggatcactcaactac

SEQ ID NO: 16490 - DNA, 139 bp, Malus x domestica
  Predicted polypeptide sequence is orthologous to G1466
gtaaaatttcatcggagatagtttgaatgatgaatcttttcagtgaattgcggtgcagcgtccggcacgatgctcgaagtcggaaaacgacggcatggggctttggttcgatggtgatttgctgacagtcaacaaaatt

SEQ ID NO: 16491 - DNA, 376 bp, Malus x domestica
  Predicted polypeptide sequence is orthologous to G1468
tttaatcgcctgatcatggacactgatgaagaagacacagacaaagaaaaagggcaagaggatgaacctaattacacaattgcaaggacgagggcggccagtaacaactgcggccacggaggctggaaggtgcttctcacagctgccggcttattttttacgcttgctctagtagttcggtcctccatctcccggaaaaagaaacgacggtagtccacaagccatccatgagtttgtaattttactggatacagacatatctttggattccctccttgtttttaagatgttttctgccttcaaaatattgaagttcagatgtgttcaacatcattaaatattgcataaatatagcataaaatacatccaaaaaaaa

SEQ ID NO: 16492 - DNA, 567 bp, Malus x domestica
  Predicted polypeptide sequence is orthologous to G1478, G1929
aagaatggacattctgctttcagtgccagtaaagaaattatcatcattgatgatgttccggaaagtgaagctgatttgacctgcagtgttgcaaagtactctgaagggttgagggaaagccaagtagtttgttccggcagtccagttccagcagctcccagttataactcaaagcgtgtgaataatcctttctctcgttatgagtcacaggaaccttctttactttgtggatcaccagttttgtacaacaccaccttgcatgcagttccctccaggctagccaataatattagtcctgttaagtggagttgtactacttcagaaggctcgggtgtgcagcaccgggcttcttttcttgcagcaccatcgccaagacgacatctgagatctacactgtacgattcaccgagcttgtcatagaaaaacatgtcgcgtttgaatgaggagaaatggcgtgcagtccacatgctgttactccaccaaacgttggttcgaaatcatgcaattttttttcaggtttctgcttaggcatgctttaagctatccagagaatagacagtgttttta

SEQ ID NO: 16493 - DNA, 1233 bp, Malus x domestica
  Predicted polypeptide sequence is orthologous to G1480
tgacaagagtgagtgctatttacgaaaactattacattgcagcagatttcggtcatggcatcgaagctctgcgactcttgccaatcggcgacggcgactctgttctgccgcgccgactccgccttcctctgcgtcaactgcgactccaagatccacgcggccaacaagctcgcctcccgccacccccgtgtctggctctgcgaggtctgcgagcaagctccagctcacgtcacctgcaaggccgacgacgccgccctctgcgtcacctgtgaccgcgacatccactccgccaaccctctcagcagtcgccacgatcgagtccctgtcacgccgttttacgattccgtgaactcggctgcaaactcggtccccgtcgtcaaatctgtcgtcaacttcctcgacgaccgttacttgtccgacgtggacggagagaccgaggtgagcagggaggaggccgaggccgcctcgtggctgctcccgaaccccaaggcgatggagaatccagatctgaactcggggcagtacttgtttcaggaaatggatccgtatctggatctggactacgggcatgtggatccgaaacttgaagaagctcaggagcagaacagctgcggcgcggacggcgtcgttccggtgcagagcaagaacatgcagcctctgctggttaacgaccagagcttcgaactcgacttctccgccggctccaagcccttcgtctacggctaccaccacgctcggtgtctgagccagagtgtatcatcgtcgtcgatggacatcagcgtcgtgccggatggcaacgcggtgaccgctgctgtggagacatcgcaaccggcggtccagctctcgtccgtggatcgcgtggcgagggtgctgaggtacagagagaagcggaagaaccgaaagttcgagaagacgatacggtacgcttcgagaaaagcgtacgcggaaactcggccgcgaatcaaaggcaggttcgcgaagcgcacggaggtggagatcgaagccgagaggatgtgccgctacggcgtcgttccgtcgttttaggttaataatgtaattaaccggtaatcaagctttgtaatttcgtttttttccccgggaaatcggctgtgggtgtaaatatcggtcgagatccggtgtactgtacgatccatggaatcttggccgtcgattttgtaccaagtttttcttctgcagtaatgaaattttaatttggtattggggcgtatcaga

SEQ ID NO: 16494 - DNA, 1235 bp, Malus x domestica
  Predicted polypeptide sequence is orthologous to G1480
agagagagagagtactcgtgcgtgagtgagcgagtgagagctttttcaatatttacgaaaattattacactgcagcagatttcggttatggcgttgaagctttgcgactcgtgcaaatcggcgacagggactctgttctgccgcgctgactccgccttcctctgcgtcaattgcgactccaagatccatgcggccaacaaactcgcctcccgccacgcccgcgtctggctctgcgaggtgtgtgagcaagctccagctcacgtcacatgcaaggccgacgacgccgccctctgcgtcacctgcgaccgcgacatccactccgccaaccctcttagccacgccgacgagcgagtcccagtcacgcccttctacgactcggtgaactcggccaccgattccgtccccgctgtcaaatccgctgttaacttcctcaacgaccgttacttctccgacgttgacggagagatcgaggcgaggagggaggaggccgaggccgcctcgtggctgctcccgaaccccaaggcgatggagaatccggatctgaactcggggcagtacttgttcccggaaatggatccgtatatggatctggactacgggcatgtggatccgaagcttgaagatgctcaggagcagaacagctgcatcacggacggcgtcgttccggagcaaagcaagaacatgcagcctcagctcgtcaacgaccacagcttcgaaatcgacttctccgccgcctccaagcccttcgtctacggctaccaccacgctcagtgtctgagacagagtgtttcatcgtcctcgatggacgtcagcatcgtgccagatgacaacgcgatgacagacgattcaaatccttacaacaagtcaatgacctccgccgtcgagtcatcacatccggcggtccagctctcctccgcagatcgcgaggcgagggtgctgaggtacagagagaagcggaagaaccgaaagttcgagaagacgatacggtacgcttcgagaaaagcgtacgcggagacccgcccgcgaatcaaaggcaggttcgcgaagcgcacggaggtggagatcgaagcggagccgatgtgccgctacggcatcgttccgtcgttttaggttaatgatgtaattaaccggtaatcaagctttgtaatttcgctttttgtgtaaatattggccgtcgattttgtacaactttgttcttatgcagtaatgaatttaatttggtatcggccgtatca

SEQ ID NO: 16495 - DNA, 664 bp, Malus x domestica
  Predicted polypeptide sequence is orthologous to G1480
cacgagggatcattttatttttattattattttgttttcttcgggtgaaaacgaaagcagagagtttccaaggcaaggccctatgaaatgttaaaaaaccaaaacgaaccaaataattaaataaagggcttttgggtgctttcaccggccaatcaataaacgacagttgaaaataaaatagattatcctcattgtcaaaacgtcggaacgacgccgaattgtgggtccgagatgaaagtcgccgagccggagccatagatgagatcgaatgtctcagtttcggttttggtgcgtttcgcaaaccggcctttgattctggggcgagtttcagcatacgctttccgggaagcgtatcggatagtcttctggaacttgcggttcttcctcttctctctgtacctcagcaccctcgcctccctgttcagtccgcagagctgagtcgctggttgactcgcaggggttgccgagaccggtgcgccgggttccgaaacgttgttgctggctttccggccgaaagggtacgatatatcgcccggttctgaaacgttgttgctggctttttgcccgaaagagtacgatacatcgcccggttcagaaacgccgttgcaggcggttcggccgatagtatacgatatatcggatagggagttttggtcggggaaca

SEQ ID NO: 16496 - DNA, 555 bp, Malus x domestica
  Predicted polypeptide sequence is orthologous to G1481
gaacttgcagaagagagagaataattttttccgagaaaacacaaagaagctgcgagaaaagaaatttccagaaactgaaggcggactctgcgtcctttgcaatcaagagagagatgaagaactgcgagctctgccggcttcccgctagaatcttctgcgaatcggaccaggcgatgctgtgctgggactgcgacgccaaggtccacggcgccaattttctggtggctcgccactccaggagcctcctctgccacgggtgccaatcgccgacgccgtggaatgcctccggcgaaaagctcggccacactttttcggtttgcgagagctgcgttgtacgagacggaagcagagacgaggaggaggaggaggtgagccaggacggtaatgatgatgaattcgattccgacaacgatgagattgaggacgacgatgacgccgatgatgatgagggcggagataatcaggtggtgccgttgtcttcgacggcgacgccgcctccgccgacttcgagcgcatcgagcagcgagcagtctgcgactgcgtccaacaatggcg

SEQ ID NO: 16497 - DNA, 624 bp, Malus x domestica
  Predicted polypeptide sequence is orthologous to G1482
gccgttttccgatgcctatccgggaagcaatctgaactctttctcatcggaaaatatggggatgtgggtcccgcaggcaccgcaagctcctccgcatcagtattcacaggtgggcggtgggttcgtcgggttcaaagagacaaaggagggtacaaacatgaatgccggcaaaagactctggatggacgatggcttcacagttcctcagatcagtcctccgtctcttggctccaagaggttcagacctttatgatacaacaaattagagtgggaagcgatttccgcacacttttttctccttctgcgctttatgttttcgtcgcttgattctcgaaggagcgcagacgaagaaaaatggtgtgcggaaatcacccatttagaattaagcctcacaagatccaatccttcaatccttctgaagtaaattttaacgcagggatttcgtttgtttgtttgtttgtttgtttttttttccttgtggttttacttcggtctcttcttcccacttttgtatgaggggagttttaaaggctttcaacaaactcagttggggtgcttcatcttcctcttctctctctcccccctttgtacttattttcgggaatgcaagcatcaatgtaaaat

SEQ ID NO: 16498 - DNA, 581 bp, Malus x domestica
  Predicted polypeptide sequence is orthologous to G1506
attttgaagagtttacgaggcaattaacaaatgaggaacaacagcaattactgaaacatctacctccagttgatgatgttaaatttccttatagcctcaaaaatatgtttgatagccctcaattcagagagaacttgacttcctttcagcaactgctagcagaaggcgtttttgatatctccttcctggggacaaaaaccgaagactgtaagactttgaaaaggcttgcattgtccaattcttcaaaatctaaatgggttgaacgctatcatcttctcaagaagtataaaactagccatggaaagtctattgtttctgcacctaacatggcatctagtaactttcgacatgtcaagagactgcgggacaacgagactcaaagtttaccagatgtaaagatgatgaaaagccccaaaaggataattatgaagggtagctatgaaaacaaggatcccatggactacgatggaggttcttgctttagtccaaaaagcctgtttgctttgcctcctgatgggagttctttcctaatggattctatgaattttgtcgacgagagttctgaccaggatctcctcctg

SEQ ID NO: 16499 - DNA, 355 bp, Malus x domestica
  Predicted polypeptide sequence is orthologous to G1510
tttgccataaaacgaacatcacaaatcataaaacaacatgcataacccagaaatttgaagaaagaacacaagtctcacctggattcaagttttagagctttgaagctctcagtttcaatggcagaacattccacggtgttctgctgactcatgcaagggtaatgttgagttcgttaagtcttaaagattccaaatatatgaattttttgttcgattttgtgagggagctaaggtgagggctaggtgaagctttcggagctgagagagagagagagagagatagacaacgagatgatgatgatgatatcgatgagttagtgggtccgggagtgtggtgatgggtgtgtgtgtgtgt

SEQ ID NO: 16500 - DNA, 694 bp, Malus x domestica
  Predicted polypeptide sequence is orthologous to G1512
gctgtctctctgctaaaaatagccattaaagctcgaagagctaattttccaagatacccagaaaaaagattgaagctttgaaggaaggatagtagtaagactgaaagcactttctgtgccgaacttctgcgtttctcttcacgtattggtgaaaaaaaacaaattagaagaaccgaaaatggcgttgcagcaattctttgcacatgaatgcaaatccatcgccggagaaacaacagaatcagaaaattccaaaggtggctttgactgcaacatctgcttagactttgcacacgagccagtggtcaccttctgtggccatctatattgctggccttgcatttacaaatggcttcacgttcagagtgcgtcccttgcctccgatgagcgccctcagtgccctgtttgcaagggtgatatatcacacactaccatggtcccactttacggccggggcctagcaacttctgaacctgagcttgaaggaaaggtggcactctacaggggaatggtaatacctcccagaccatcggcatgcgatgcgcaagctctcatatctagcacctctcagacggtccagcaacttccgtatcgtaacccttatcagaaccaacaatataaccctcatccatacagcagtttcggggaacattcttcctcgccgctgcttgacctcgggagcactgcagtggcaggt

SEQ ID NO: 16501 - DNA, 678 bp, Malus x domestica
  Predicted polypeptide sequence is orthologous to G1512
caacatatgcttagattcagcacatgaacctgtggtgactctctgcggtcacctgtactgctggccgtgcatttacaagtggcttcaggtcccaaccgcctctgatgaacaatcccacccgcagcagacttgtcctgtctgtaaggctaacatcaccccttcttcagtggttcccctctatggtcggggcttatcctcttcagattctgatggaaagaaacctcagttggatctggtcgtaccacatagacccccaccgatgttgaacacttcgattactgctacaaccgccacatcagtgccaagacagcaacttcatccaaattttttgcaaaggcattcagagtctgttcacgatcagtactaccccgcttatggtggttatgctacaaactcagaatcagcttatctcgggggcacaacgttgacaaatttatccaatccaacgattggaatggttggagagtttgtgtttgaaaggatgtttgggagctcaaacactaatttgtttacttacccgtatccgaattcgtacacccaaagtagtcataggatgagaaggcaggaagtagagctggacagatctctcaatagagtaaccatctttcttttctgctgttttatgctgtgccttctcttgttctgagcatattctttatatagcttcactcttgtaca

SEQ ID NO: 16502 - DNA, 785 bp, Malus x domestica
  Predicted polypeptide sequence is orthologous to G1512
aaatcgccattaaagctcgaattgcaaattctcgaagatacccagaaagaaagtttgaagctttggtggtaggaagctctcaaggattgaaagcgattgctgtgccgatcttctgggtttctattcacgtactggtgaaagaaacaaaacaaattaaaagaaccgaaaaaatggccttgcagcaatactttgcacacgaatgcagatccgtatcgggggcaacaacagattcagaaacttccaaaggtgggtttgactgcaacatctgcttagaatttgcgcacgagccagtggtcaccttctgcggccatctattttgctggccttgcatctacaaatggcttcacgttcagagtgcctcccttgcctccgatgagtgccctcagtgccctgtttgcaaagctgatatatcgcacaccaccatggtcccactttacggccggggccaaacaacttccgaacctgagcatgaaggaaagatgacactctacaggggaatggtaataccgcccagaccatcagcatgtgatgtgcaagctctcatatctagcacctctcagaccgtccagcaacttccatatcgtaacccttatcagaaccaacaatatgaccctcaatcatacggcagttttggagaacatccttcctcttcactccttgacctcggaggcactgcaatggcaggtgtccaccatccggcggttggggtatttggagaaatggtttatgcaagggtgttcggaaactcagagagcgtatatgcgtacccgaattcttatcaccga

SEQ ID NO: 16503 - DNA, 653 bp, Malus x domestica
  Predicted polypeptide sequence is orthologous to G1519
attcgtgctaacctcatgttcttttactttgaaggcctcttctatcatatatcaaaacgagcagcaggcattcgttatgtgttcatcggaaaaccatctaaccaaaggcctcgatatcaaattttaggcgtatttctattgattcagctttgtatcatagctgctgaaggactgaggcgcagcaatttatcctctattgcaagttcagctcagcagacttttggtacgcaccaaacttctgcaggtcgagatttgcctgtgttaaatgaggaaggtaatttgatatctgcggacgctaccaggggaagttgggtctctgaatcttcgacttcagagtctcaggccagcgggagcagcaaatgcacactctgtttgagtaatcgccactacccaacagccacaccttgcggtcacgtattttgctggagctgcatcatggaatggtgcaacgaaaagcccgaatgccccctctgccggactcccataacccattcgagcctagtttgcttgtaccattcagacttctagcgtttgatcgtgccatcgcggtcagccacagaattcgccattcggtaatcagaaacaagaaacgacttgcagtaaagcaacttgtcctctgattccacgcggttagtgtctgtagtaatatcata

SEQ ID NO: 16504 - DNA, 598 bp, Malus x domestica
  Predicted polypeptide sequence is orthologous to G1638
tcatgcacaaaaatactttatcaggcaactcacaggagggaaggacaagagaagatctagcatccatgacatcacaaccgtcaatcttcctgatgtgaaacccgcctcaccagacagtacttctaaaagcccaccatcatcggatctctcctcaaccctggtgcagcagccacaccagcaccagaagttggccagcgtgagcattgactggaaatcgcccgatgagggacagcaaatggttttcggttctgcaaatgggaacaacttcttgggaccgttttgtgggatgtcttcacatgtacctaagcttgaggagcaaaattttctgagtggcaatcttcatggatcgcagttgggacattacaacgcctgttttgagatgcaatcaatgcgatatcagtgaacgtgtgcattagttcgatgtttttggagcgagaagagagtgtactatttgacctatggtgaacaaaagtcgatgaggactgagagtagttagtccccaggttcttggactctacaaaaagatcagttagttcatcttgtgatttaatattcgaattctgaaagtattgatccaaaaaagggaacttatttacat

SEQ ID NO: 16505 - DNA, 577 bp, Malus x domestica
  Predicted polypeptide sequence is orthologous to G1638
tcatcaaacagtacaaggaattagaagaagatgtcagtgatatcgaagccgggcttatcccaattcctggttacaccagtaacaatttcacattggagtgggttaacgatcagggatttgacgggttgaagcagttttacagtgttggtggaaagcgaggtgcctcgactaggcccgctgatcaggagagaaagaaaggggtgccatggacagaagaagaacacaggcaatttctgatgggccttaaaaagtatggaaaaggtgactggagaaacatctctcgaaattttgtgaccacaaggacgcccactcaggttgctagtcatgcacaaaagtactttatcaggcaactcacaggagggacggacaagagaagatctagcatccacgatatcacaacagtcaatctcctcgatgtgaaaccgtcctcacctgacagtactaagagcccgccatcatcggctcattcctcaaccgtggtgcagcagccacaccagcatcagaagttgaccggcacgagcattgactggaaatcagccgatgagggacagcatttggttggttctgcaaatgggaa

SEQ ID NO: 16506 - DNA, 631 bp, Malus x domestica
  Predicted polypeptide sequence is orthologous to G1638
tcacgaggcagtgttggtggaaagcgaagctcctcgactaggcccgcaaatcaggagaggaaaaaaggggtgccttggacagaaaaaaagcacaggcaatttctgatgggccttaaaaagtatggaaaaggtgactggagaaacatctctcgaaattttgtgatcacaaggacgcccactcaggttgctagtcatgcacaaaaatactttatcaggcaactcacaggagggaaggacaaaaaaaaatctagcatccatgacatcacaaccgtcaatcttcctgatgtgaaacccgcctcaccaaacagtacttctaaaagcccaccatcatcggatctctcctcaaccctggtgcagcagccacaccagcaccagaagttggccagcgtgagcattgactggaaatcgcccgatgagggacagcaaatggttttcggttctgcaaatgggaacaacttcttgggaccgttttgtgggatgtcttcacatgtacctaagcttgaggagcaaaattttctgagtggcaatcttcatggatcgcagttgggacattacaacgcctgttttgagatgcaatcaatgcgatatcagtgaacgtgtgcattagttcgatgtttttggagcgagaaga

SEQ ID NO: 16507 - DNA, 654 bp, Malus x domestica
  Predicted polypeptide sequence is orthologous to G1640
aagagatcaacaattttagctatggactgccatgttccgtcactcacacaaacgacaggaacagctctcccacaagaactagccaaggcggtgaataaacagaagacactggaaagcatcggcgataaacaaggggaagcagtaagccgtctgggaacaacgttgatatcgctggtcgtcttttatatctccctacaaaccttcatattccattctgttagccaaaatccaaacattccgtgcaagttctggtgggcgccgttcagcctctcgtgtctgaattgtgtcatcttcaccatccccttcaagagtttcgtcacgagatgggagcgtactcaacgttattacgatatcaattttcttgagcaagatttggttcacctcgagattgtgattttctcctcggatcacgatcagcagctggagcagccggcggagatgttgaggagcgatacgacgaaaatatatcagagacgcgccttcatctgtttggtttctttagctcttgtcgcgtacactattgtcgtcttaacggcatgtcgatacattccctgtcacaaagttgctgttctgtaaacataggtggttggattaagacttcaaattactctcggaccgattaattaatttggacagctggcctcttgattattt

SEQ ID NO: 16508 - DNA, 686 bp, Malus x domestica
  Predicted polypeptide sequence is orthologous to G1645
aatatcccaaaaagtgaatcagaacagaaggcaaagaatcatcagcaaaaactttcaatcatgttgctaaggagctcatcaacaccagtaattggatctctccttacatcctacgtctcagaaagtcctaacatcatcagcaatcatcactctgatcccaaaccaagcaccttccaccaacacactcccaccaagttttcattccaccaacctggatctctcaacatctcacacaactcctcaccaatctctcattcctccctcgatttggaccggcattcgctaaccgggttccgaagggctcagtctgatgggaacttggaaggactggcctatgcttcttgtgacaccgaagatcagttcttggattcaaaactacccaacatgttctctgcaagatccaagtgcatgatgctggaaactataccgtctttttcgttgcataagtcgggaggttatgaagatgatgaggacgatagtgacgtggaatatgaggaagaggagtttggtgaggagaatacggagagagttgtggcaacggaaggcaaaaatgttggtttagaggagaagaggaagaacgtgagcttaactcaggatttgaaatttttggacaaaatatggagcgcagggattgaagaaaaaagagagcttgcgagtcaagaaatgtatcttgcaaaggggcttgg

SEQ ID NO: 16509 - DNA, 463 bp, Malus x domestica
  Predicted polypeptide sequence is orthologous to G1655
gaaggggacgactctgtggagcagggcgatcctaacaagtcgaatgaggctgagcaaaacgcttcacaagcggagaagggcgagggtaacaggggacaaccggttgaagaaaacggagtttaggagagagaggaggaagttaccggctgtgcagaaaaaggttcgggttctgagccaattggttcccggctgccggaagacgtcgttgccgaaccttctagaagaaactaccgattatatagcagctttggagatgcaggtcagagccatggcggctctcgccgagttactttctggttcaccggtgaaccgctccggctcgagtggcaactcttcgagttgacgctgagagtcgcccgcctaggcttattgtgccaggtgttttttttttcttttgtaatttttataaatattttaatcttatgaaagttatttcgtgtaaaaacaaaaaaaaaaaatgctg

SEQ ID NO: 16510 - DNA, 672 bp, Malus x domestica
  Predicted polypeptide sequence is orthologous to G1655
acctccacccaaacaaacaactcaaactccgctctctttttatcacttatcaggggtgtgcgtatatatatatcggtgattgttgaattgcactctcaacatatttcaatatcttcttccatggcggcgtcgatgatgtcgaactttgacggaagcctggacgcgttgtcgatggagtcgagccggaaaaagcggagaaaaaccggagtcgttgaagaggatcagaatcggagcttagaaaccggagtccgatggagatccgagacggagcagcggatctactcgacgaagctcgcggcggcacttcgtcaggtgcgacggagatcgtctacgtcgtcggcggcggtggcgaaggtagcgggaggcgggagagacgtgaaggaagcggcggaccgtgttctggcgacggcggcgaaggggacgactcggtggagcagggcgattctaacggctcgtctcaggataagcaaaacgattcacaagcggagaaaggcgagggtgaccggggacaacaggttgaagaaaacggaggttaggagagagaggataatgttaccagttgtgcagaaaaaagttcgggttctgagccggttggttcccggttgccgaaagacgtcgctgccaaaccttctagaaaaaacgaccgattacatagcggctttggagatgcag

SEQ ID NO: 16511 - DNA, 525 bp, Malus x domestica
  Predicted polypeptide sequence is orthologous to G1660
agcaacaatctgcagaaaccagtgagttttctgcatttcgtctcggaccggctagaatcggtcgaccggctcagatcggctctgtctctgtgctcgatcggacgggccggttagatcgaaggctggatcgggtcggactggctgaaccggttggatcgggggtcgtacagatgaaccgggtcggatcgggtctgaccggatggaccggtcgaagcggctgaaccaggtcggactttcgctcggccggcggagaccagccaaggttgacggaatgggcttcggacccgatggtttgataactcccatgatgtttcggaggcatggttttaggggacttgtgctaaaacttgtgagacgcagcaaactcaactctgaatttaacttttaacttgttaccaatctcgaaatcgatgcgaaagaaaatgatgagacgagattaaaacccttgtttgaaattccttgatttgaaaagaattctggatcagtaaatcaatggttgacaaaatggatctcccgctagaattt

SEQ ID NO: 16512 - DNA, 518 bp, Malus x domestica
  Predicted polypeptide sequence is orthologous to G1660
gtcaacgggcgatcaaacccgtaaggcgcaaggaagctgagaaagccaagtatatggctaggttcaagcgtgaagagatgaaaatacaagcttgggaaaatcatcagaaggcaaaaacagaagctgagatgaggaaaatagaggtagaggtcgaaaggataagaggacgcgctcatggcaagcttatgaataagttggcagctgcaagacataaggctcaagaaaagcgagcagcagcggaggccaggagaaaccggcaagcagcgaaaacagaacatcaagcagagtacattcgcaaaaccggtcgcatcccgtcctcgttttggtgttggggttggtgctcttgatatcggaatcacaatctgcaaatgtatgtccatgttaatgtaaaaacctaaaaactttatctggcttatcctatgaatgccggaaagtaaagtactcaagtgtaattatcgtcaacatggcgaagggtaatgctgtcactttgcttaaaaaaaaaaaaaaaaaaaaaaaaa

SEQ ID NO: 16513 - DNA, 816 bp, Malus x domestica
  Predicted polypeptide sequence is orthologous to G1662
gaaaagcaatttttgagtaattaatcagaacatttggagaaatctttctgcagaaagacatagaattaagaaatggaaagtggttatttttcagcttggaagagtaacactgattctttgcatgggctgttgaatgcggaagaagccgaagagctgaaaatcgcggcaccattgcctgcgatcccccagccacaaactccacaggagcctatggagttcttgtccagatcatggagtctttcagcttccgaaatttcaaaggctctagctcaaaagcaaaaacaattttccgtcgaaaaaagtcccgaaacattcccagaagcaactgttgtgccacagctaacaagcaagatcataaaatctgtcaacaatcggagaacggggtcaatcggaaaatggttccaccatacggatttgagtagtagtgcagtgaagaagaaagacaaggaacgggtagaaagggcgcgagtgcattctgcggtctccattgcaggtgttgctgcagccttggctgctgtaactgcagcagagaactcgaatggttctggctcgaaaaccaccatggctttggctttggctacagagttgctggcatcacattgcatcgaaatggctgagttagccggcgctgatcatgattcgcgtggcatctgctgtcagatcaccagtggacatccggagtccccggtgatcttatgactcttacagcagcagctgctaaagctttgcgaggagaatccgctttgaaaaaagactaacaaaaaagcaagaaaaatggctgcattaatccccatgaaaaggaatgggggaaattcc

SEQ ID NO: 16514 - DNA, 388 bp, Malus x domestica
  Predicted polypeptide sequence is orthologous to G1666
caaggtgaaggataacgtgaatggcaagaaaataagtattacggaagtgaagagggtgataaatcaaattatacctcaatctgactcttaatccgttattagttgtgtttgtgtaaaaatctgcaggacgatttaggataagcagtttgtgtacgtaattaaagagttttgaaggggaaaaaaattggaaaacaaaataattctgattggtgtttatgggtcatcagtgctacttactgtacaatgttaactagaacattttttttttccttctttttactaattggtgtgtattgtttattcccctgtattgtaatctaacaaagtgtattatttccaagacatttagcataatctaaaaatcattatatctttcaaaaaaaaaaaa

SEQ ID NO: 16515 - DNA, 308 bp, Malus x domestica
  Predicted polypeptide sequence is orthologous to G1666
cgacgtatagagaagcttaatgagaggtttattatactaaggtcgcttgtgccttttgtgacaaaaatggacaaggcttccatattaggggacacaatcgagtacgtgaagcaactgcgtaagaaaattcaggatctcgaggcacgtaacgtgccgatggaggatgatcaacagtcgagatcatccggggaaatgcaaaggtcgagtagttgtaaagagttgcgaagtgggctcccggtagtagagcggacacaggccggtcacgggtcggataaaaggaagttgaggattgtggaaggaagcggtgg

SEQ ID NO: 16516 - DNA, 334 bp, Malus x domestica
  Predicted polypeptide sequence is orthologous to G1706
cacggttgttagtgcagggaattctaatgcccccgtaagtagtactgtagtcacaagcgtgccggctacagtcgccgctcccggtggctcggtctcagccgtgccaaaaggaaattagtaggttgcttttgacaaaattgtcagccccttggtgtcaacacaattttcatcaatgtgtgaactgagtatgagcgtcccctgtatactaattctgaatgacaagactagttgaaaagtgttgtgagagatttttaatttcaattgtagccttcagttgttcaatcaataagctttcagttaattattttgggaaaaaaaaaaaaaaaaaatcggt

SEQ ID NO: 16517 - DNA, 614 bp, Malus x domestica
  Predicted polypeptide sequence is orthologous to G1718
ttttcccaaacccttctgattcttcgtcttcccaaatccctctcaaagtttctctcttttttcgttctcaatcccgaaaaaacccggagaatttcatggattccgaagctgagttctcttccttcttcgactggctcacgaggagggatcgagcccgagagctatccgtgctcatgcccttaatattaggtgcagccgccgccgcctccgccgcgacacccgacacggaagacccagatgcaggaaaccccgaaagacgaaccccgcgggagcgaatagtcctcatcgaccctttcagccaacgcgtggcggtgatcgaaggtggttcggacctggactcgctgctccaggggctgggtggcaaggacggtcagccgccggcgtcgaaggcgtcgatcgacgccatgccgagtgtggagattggcgaggcggatggtgggtccgagtgcgcgatttgcttggagcagtttgaggtggacggcgtggcgaaggagatgccttgcaatcacaggtttcatgggggttgtatagagcagtggctgacgcttcatgggtcgtgcccggtttgcaagtttaccatgccggttgaggaggaggaggtggtaacgaaaatc

SEQ ID NO: 16518 - DNA, 598 bp, Malus x domestica
  Predicted polypeptide sequence is orthologous to G1743
ctcttcccctcccccccctctctctctctctctctctctctctctctctctctccaaaatacacagatttaaacaaaaacccagttcgtatctcgaaactccacagccaaatcacaacccaaaacatcaaagctcgaagctgtccaatgggttttccagttgggtacacagagcttctgctcccaaagctcttcatccacacactcactctgctgggtctaatccgaaagctcatctccaccttcttctccctgctgggtctccaagatttcatcgagcccgacaatgcctggtccgatccgccaatccgattcccggagttccactctgtctccgccgttctgatccgggaaatccttcccctggcgaagttctcggacctggtcgacccgcccgagtcgtgcgctgtgtgcctgtgcgagttcgagagcgaggacgagatacgacggctcacgaactgttgtcacgtcttccacaaaaggtgcgtggaccggtgggtcgggtacgagcagaagacgtgcccgctgtgtcgtacgccgttcatatcggaagatatgcagggcgatttcaatgagagactttgggccgcttctgggat

SEQ ID NO: 16519 - DNA, 646 bp, Malus x domestica
  Predicted polypeptide sequence is orthologous to G1743
cacgaggcccctccctccctccctctctctctctctctctctctagctcttcccctccctccctccctccctctctctagaaaacacatagaaactaaacaaaaacccatttcaaatcttcaaactccataaccgactcacaacccaaaacctcaaagctcgaggctttttaatggggttcccagttgggtacacacagcttctgctcccaaagctcttcatccaaacactctctctgctgggtctaatccgaaaactcatctccgccttcttctccctgctgggtctccaatatttcatcgaacaggacaatgcctggtccgacccgccggcccgattcccggagttctactccgtctccgcggttctgatccgggaaatcctgccgctggcgaagttctcggacctggtggacccgccggagtcgtgcgccgtgtgcctgtacgagttcgagggcgaggacgagatacgacggctcacgaattgtcgtcacgtcttccacaaagggtgcgtggaccggtgggtcgggtacgaccagaagacgtgcccgctgtgtcgtacgccgttcatatcggaggatatgcagggcgatttcaatgagaggctttgggccgctactgggatccctgatttttacggtgattat

SEQ ID NO: 16520 - DNA, 516 bp, Malus x domestica
  Predicted polypeptide sequence is orthologous to G1752
agcctgcagctaatgatcctccgaggaaccctgcaccagcatcaacaggctatgggaaagaagggaattctagcagtgaaatttcatcaagtggctcatcaggagtgacagaatctgaatactccagctcctcaaaacacgactagtttaaacaatctgaacaaagaccgttttttctgtttgaagattctggtgttctgcgtacttttgtaaaggtgttagtcacgtatcatcctcgtatattagttctgtgagcttgtatgttacctttgcaagcgtacagcagtaatagttttgtaggcatcattttttagcgagtgccgcatacaaggggcaatttgctgttttaggaagccccattaagtatttattttgtcagtataggtgtgttcttgtttatttggtgttgttggaggagctactaaacgctcctttcaatgatcgatatggatatcgatcacgttcgttgattgcatcacttttgtattgctaaagtagtaaccttgcttggtgttg

SEQ ID NO: 16521 - DNA, 369 bp, Malus x domestica
  Predicted polypeptide sequence is orthologous to G1777
atttcagaggagaaggattcgaatctcagagattttagttgggtaaacaatggactctccagacttttcagatcaaggagggttctttcatattcgtacccatttgctttttatatgtttggagaagagctgtttaaggatgagatgacaaaggaggaaagggaaataaaacaaaatttgtttgaggaccagcagcagcaacttgaggaaaatgttgagaaattatccaagtgtttggagtcgccttttgatcagtatagtgagaatgaagttatggatataaggatgcaagtgatcaatctctcagcagttacagataccctatgtcagaaaatgtatgactgtattgagactgatttattgggctct

SEQ ID NO: 16522 - DNA, 432 bp, Malus x domestica
  Predicted polypeptide sequence is orthologous to G1777
tgggttccctcaagaggacaaggcacagcattgctccttacaagtcaaatggtgtggagaaagcttcagaacttacggtttctagggacaccacaacctctaactccgaaagtgatttggccgcctccaacgctgactagaagataacccggcgatgagtaacagaaccttgtcaaccttcatctagctttgagagttcgggcgaaagccgatgctgacgatggttcccgtcgtatacatcttaacattagagcgctctgttctcgtttccaactgagttttcccgacataatcacattttactgcataaggttaggcttagaacattactgtttagaaacctagtttttttatcagatttatgaacttttttggtcttcataaaaaatagagagatcctcttttgttcaaaaaaaaaaaaaaaaaatgctg

SEQ ID NO: 16523 - DNA, 373 bp, Malus x domestica
  Predicted polypeptide sequence is orthologous to G1789, G1911
tgggaagtctgctgaggaggtgaagcggcactatgagctcctcattgaggatgtcaagcacattgagtctggcagagttccgtttcctgattatagaggggaataatactaaatctttctctctttggactttgaatggcaaaggctcttgaagtttatgatttctagcgtttccattaagttcatcaagaaacaaagttgtgaaaattagcagatgcatgcagacatgtatatgtaattaaagaaaaccagttggttttatgcagctaaattaaccattgtcgtggctttcgatcagtgtacgaagtagcatctatttggtctatgaaattcaatactactacgattagaaaaaaaaaaaaaaaaaatcgtg

SEQ ID NO: 16524 - DNA, 660 bp, Malus x domestica
  Predicted polypeptide sequence is orthologous to G1789, G1911
cacgaggtttctcctctctctctctctctccctctctccctccctccccttaattttccttccacgcttttaactgtagtgtttatagaaaaccatctcactctaagaaattattcaatggcatcaagctcaatgtcctcaagaggctccgactcctcctggactgccaagcaaaacaaagcctttgaaaaggctttggctgtctatgacaaggacactgccgaccgctggtacaatgtcgccaaggcggttggtggcaaaacaccggaggaagtcaagaggcactatgagcttcttgtagaagatgtcaagcatattgagtcaggccaagttcccttcccagattacaggactactggatgagaaacctcaagcttcactggagcagtataactcacagtttatccactagttaataaataaagattggtcactcgatcgcttcatcttcatcgttacatcgctagctaggcgccattttaatgttcaatgacgctgtggtcatggtatagttttgtgttcagtcgtttgagaaatcacaatcagtgattcttttatgtatgtactttgtactagtttccgtttctttcatttgtttcttgctactctaagcttaaagtatgtatgtatgtatgtatgtatgtaccaaaggcatgcatg

SEQ ID NO: 16525 - DNA, 739 bp, Malus x domestica
  Predicted polypeptide sequence is orthologous to G1835
tcgaaactagaacaaactcaaaggactatttgtgacggagaaaatgatcggacagagctttatcgacgatatagactgcgggagcctgttcgacaccatcgacgacctcctcgatttcccaacggacgacgtggagtccgccctcggccccgcccccgactgcaacgccgctttcaactcctcctccctctggcccagccagtccgcctccctccagccacccaatgaagccgtcttctccggcaactccgcctcagacctctccgccgagctcgacgttccgattgaagacattgttcaattggaatggctgtcaaacttctgcgaggattccttctccggtggaagcctaacgatcaacaaaccagacaactccttcgtcaacaacgaatcatcccaccggcagttccagacctccagccccatttccgtcctcgacagcagcagctcctgctccgtcgagaagaatgtgccgcaaagccctggcccggtggttcctggcaagcgcggacgcgctcgcagcaagcgtccccgcccagctacattcaaccctcgtcccgcaattcaactcatttcccctgcctcctctgttactgaggccgaggcccttcagcatcagcctttgctccctccgaagctccattcggattctgagaatttcgcagagtcccgtcctgtgatcaagataccgaggcaagcttccggggagcagaagaagaaaaagaagatcaagttgacg

SEQ ID NO: 16526 - DNA, 563 bp, Malus x domestica
  Predicted polypeptide sequence is orthologous to G1835
agttttttttttttttttttttttatctcaactacgaagactgttctcattttccagatataatgaaataaatgactactactgctgctactactagtactgctatctgaatttcctactgggccgacgataaaatccccatactcgccccctggcaagacttgcttctcagctcgatgaccttcttgtgcgagtttgaatgcactgaagcgacgaatgtagggcttgctgcagggcggtactccgggaggaggcggccagacctgtaccgaaccccacatgcattgcaaagggtcttcggtcctagtggcccttccctccactgaggggtcttcgtcacttgacaatgcgtgcatcttttagtctcccgactctcacctgcctcgtccatggagagctttcccggtttcttcttctgttttcttttggcagtgtttgatgtatcctctgtgcgagaggcttctaagtcaaattcacaagcatcccaacgatataaattttcagaggcagaggaattggatgaggtactgaggatgaactgtgtactgaaaataattgggttt

SEQ ID NO: 16527 - DNA, 539 bp, Malus x domestica
  Predicted polypeptide sequence is orthologous to G1835
ctctttctctctcctcctctctctctctctctctctctctctccctctcctctatatctcactcctccttataactgagaaggaatagggttttggtagttttagtagcaccagcagaagcagtaggaggtttttgtggctctgcaaattttggggattctttcttcttcttcgtcttcttacgggtttgtttaggcgggagagtgaagttagagttcgaaaccaaaacaagttcacaggacaatttgcgacggagaaaatgatcgtaccgaactatatcgacgatatagactgcgggagcctcttcgacaccatcgacgacctcctcgatttcccaaccgacgacgtcgagtccgccctaggccccgcccccaactgcgacgccgccttcaactcctcctccctctggcccggccattccggctcgctccagcctcccaacgacgccgtcttctcctgcaactccgcctccgacctctccgccgagctcgacgttccgattgaagacattgttcaattggaatggctgtcaaacttct

SEQ ID NO: 16528 - DNA, 396 bp, Malus x domestica
  Predicted polypeptide sequence is orthologous to G1835
ttttttttttttttttttgtaaccgactcgtcgtttcccatatagccatcaaaactgagctcaaatatttgggttttacatgtcttgatgcatgaaggcatttgctatttgactgatattgttatgatcttgtaattcaattaatgtacaacgattagacaaatgatgtgcgtctcaatccatctttagatgtaacggaagctcgcagggctgttttgactagggatgctggtcgaggttgtggctgttataatcatcggcgtccattgcagcatcattctccaccattgaagcaacaaacaaactccacacagaagcgcagttttcgtcaccggcttagttgctatcatgtagcttcatgtcctctaaagggactgagacgactggggcattctc

SEQ ID NO: 16529 - DNA, 608 bp, Malus x domestica
  Predicted polypeptide sequence is orthologous to G1852
gggggctgcatcttcatcatctacagtcccgctctctttctcctcccatcgccactctctcaccaccatcacttaaaccctaacaatccaccgacgtaattctgcccatccctattcaaaatcccttctttttcaaaacccagaagccaaatccgggcaactttccgacccggatgccaatttgatcggatccgaacccccttgatccgaaccctaatgggtcacctgaacctgcccgcatcgaagcggagcccgcggcagtggcgcctcctggaccttatctcggcggtcttcttcggcatagtgattgtcttcttcctcttagtcttcactcccttgggcgactcgctcgccgcctcaggtcgccaggctcttctcttatcgaccaacgccgatccgaagcaacggcaccgtctagtggcgttggtggagctcggacagcaccaccagcccattgaagcctgcccagccaatgccgtcgaccatatgccctgtgaggacccccggcgcaacagccagttgagtcgggaaatgaacttttacagagagaggcattgccctctgcctgaggagaccccgctctgcttgatcctacctcccaatggcta

SEQ ID NO: 16530 - DNA, 610 bp, Malus x domestica
  Predicted polypeptide sequence is orthologous to G1852
ggttgttccagcccgcaagtcctcaacgctttctgtaatctttgacagaggtcttattggagtctaccatgactggtgtgagcctttctcaacataccctcgttcttatgatttcatccatgtaacgggcatcgaatcacttataaagcatccaggttcaaccaagaacagatgtaacatagttgatttgatggtggagatggatcgaatgttgcggcccgaaggaaccgttgtggtcagagactcccctgaagttattgaaaaaatagctcggatagctcatgccgtaaggtggactgctaccatacatgaaaaagaagcagcatcgcacgggcgagaaaaagttctcgttgcaacgaaaatcttttggcagttgccttcggtgtccaactgacagccgttttccattaaaatgttggtataaatccctattctccatttaatcttttatccgatgtgaaaattcatctccatgcatcaaaggatgcagtttctttcttatcatccaccatttcctattgtgtaaggagttaataggttgagaatagggagtgcttgaaagatgggaagacatgcacttcttttttgttagattacacaggaaaaaaaa

SEQ ID NO: 16531 - DNA, 564 bp, Malus x domestica
  Predicted polypeptide sequence is orthologous to G1852
ctctctctctctctccctctctctctcacctccaacacataaaccctagcaatccaccgacctaatttctccccatcccaactcaaaatcccctctttttcaaaacccagaagccaattcgtccattttgcgacccggatgtcaatttaatcggatccggacccccttgatccgaaccccaaatgggtcacctgaacctgcccgcctcgaagcggagctccaggcaatgtcgcctcctcgaccttatctcggcggccttcttcggcatagtgattgtcttcttcctcttagtcttcactcccttgggcgactcactcgccgcctcaggtcgccaggctcttctcttatcgaccaacgccgatccgaagcaacggcaccgtttagtgacgttggtggagctcgggcagcaccaccagcctatagaagcctgcccggccgaggccgtcgaccacatgccctgtgaggacccccggcgcaacagccagttaagtcgggaaatgaacttttacagagagaggcattgcccctctgcccgaggagacccctctctgcttgatccccacc

SEQ ID NO: 16532 - DNA, 734 bp, Malus x domestica
  Predicted polypeptide sequence is orthologous to G1852
gctgacaaaagctcctgcaagggccacagtcatgagaaatgggatcgatgtgtttgaggcggacacacgacgttgggcaagaagagttgcttactataagaacaccctaaacctgaagcttggaactccagctgtacgcaatgtcatggacatgaatgcattttttggaggttttgctgctgcactgaagtctgatcctgtgtgggtgatgaatgttgttcctgcccgcaagtcctcaactctttctgtaatctttgatcgaggtcttattggagtctaccatgactggtgcgagcctttctcaacataccctcgttcttatgacttcatccatgtaactggcattgaatcactcataaaacatcaaggttcaaccaagaacagatgtaacatggtggatttgatggtggagatggatcgaatgttgcgtcctgaaggaatcgttgtggttagagactcccctgaagttattgaaaaaatagctcggatagctcacgccgtaaggtggactgctaccatacatgaaaaagaagcagaatcgcacgggagagaaaaagtccttgttgcaacgaaaaacttttggcagttgccatcggcgtccaactgacagcctttgtcctttaaaatgtaggtataaatctctattctccatctaatctttatccgatgtgaaaattggtctccatgcatcaaaaggatgcagtttctttcttgtccactgttccctattgtgt

SEQ ID NO: 16533 - DNA, 671 bp, Malus x domestica
  Predicted polypeptide sequence is orthologous to G1855
ttgtactgggggaggtcaaaacgggctatatagagagccttgactgagatttttttcacatcaggtaaaaaaagcactttctatttaagaagctttttctttagagaaatacaagttacccaatttgcagctgctggttcccagtacaaatctttgcttgtttccagtggatttgttgggtttgtggtgttttttgccataaaacttggggtgcagaaagaagcaaagaataagaaaaaagggaaagaggaaaggttcagacgtcagtgtagtttctttaagattttgagagaactttagggtactgagtacttgttttgtttctagcttcaaacttctgtcgctggaaatagaaagaacaatatggccagggattatagtggtggatcgccaaagcatcaccacatagaatccaagaagaagaggctcacttggatcttcggtgttagtgcgctctgcatagtatgttacatgttaggagcttggcaaaccacttctgcccctgtcaatcaatctgagctctaccaaagggttggttgtgatgaaacgccatctcaatccgggaacaaaacttcctcatccgtgtcatcatcatcatcatcgcttcacttggacttcgaaagccatcatcaagtggacatcaacaaaactgaggctgtccagaagttccc

SEQ ID NO: 16534 - DNA, 688 bp, Malus x domestica
  Predicted polypeptide sequence is orthologous to G1855
agttcctgctatgattggtgtcatggcttcgaagaggcttccctaccctgcaagggccttcgatatggctcactgttcccgctgcttgatcccttggacgaactatgatggtatgtatctaattgaagtggacagagttctaaggcctggtggttattggattctttccgggccgcctattcactggaaaaaacactggagaggatgggagagaactcaacaggatttgaaacaagagcaagattctattgagtctcttgcaaagcgcctgtgctggaagaaggtgatcgagaagaacgatctagcaatctggcaaaaacctatcaatcacgtcgaatgcattaagagcaggaaggtgtataaaacaccacatatatgcaaatcagacaatccagatatggcttgggaaagagaaatggagagttgcatttctcctctaccggagacgagcaatcccaatgatgttgctggtggggcgttggagaagtggcctcagcgtgcatttgctatcccgcctagaatcagcagtggttcaataccaggaatcactgctgataaactccgtgaggataatcaactgtggaaggaaagggtggaccattacaagcggatcgtaccaatttccaagggaaggtataggaatgtgatggacatgaatgcttacctcggtggatttgctgcagcattg

SEQ ID NO: 16535 - DNA, 774 bp, Malus x domestica
  Predicted polypeptide sequence is orthologous to G1855
cgttgctgtcggtggcatgttttgtgcttaaaagggaaagagacatggagagttgcattactcctctaccggagacaagcgatcctaatgacgttgctggtggggcgttagagaagtggcctgaacgtgcatttgctgtccctccgagaatcagcagtggttcaataccaggaatcacagctgagaaactccgtgaggataatcaactgtggaaggaaagggtggaacattacaagaggattgtaccaatttccaaaggaagatatcggaatgtgatggacatgaatgcttacctcggtggatttgctgcagcattgtcaaaatatccagtgtgggttatgagcaccgtccccgccaactcaaaccaggacacccttggtgtaatttacgaacgtggttttattggaacgtaccaggactggtgtgaggctttctcaacgtaccctagaacatacgatctcatccacgctggtggggtcttcagcatatatcaggacaggtgtgacataacactcattttgctggagatggataggattctgaggccggaaggaacggttgtgtttagggatacagtagagatcctggtgaagataaaggcgattacagacggaatgaggtggaagagccagattatggatcacgagagtggaccttttaacccagagaaaattcttcttgcagtgaaaacttactggactggtgaagaaaaaagggaagctagtagagatgtagcagtgtattcttctttcccttttgcttgcattctacttt

SEQ ID NO: 16536 - DNA, 570 bp, Malus x domestica
  Predicted polypeptide sequence is orthologous to G1863, G2334
caagcttgaaccccaccccatctctctctctctctctctagatggactttcaccttgagcaatggagaacccagcagcatgagtcagaggaacaacattctgcaaagataccaaaacttgaccttgatccccatcaaaactcagagcttccatctgctgggtatgctctccctctgtttgttcctgaacccaacaccaaaatcctgtcagcagcattttctgaatcctcacctgccacctccagatttcccaaagaaatgggaagctatttcagcttgtcacagtggcaggagctggagctgcaggctttgatattcaggtacatggtggccggtgcggctgttcctccggagcttcttcagccaatcaggaaaagcctccattctgctccttatttcctccaccaccctctccaacagttccctcaccttcaacctgctttgttgcaatcagggtattggggaagagctgccatggatccggagccaacgaggtgcaggaggacagatgggaagaaatggcggtgctcgagagatgtggttgcaggtcaaaagtactgtgagcgccatg

SEQ ID NO: 16537 - DNA, 522 bp, Malus x domestica
  Predicted polypeptide sequence is orthologous to G1863, G2334
acaatgcaagaagcaatgctagctcaatgaactcggccaccagcctctccatttcgatacgtggaactacctcatcggatgtgtcgttgaaattgtctactggcaatggggtcgagccaggccaccaggacagccatgctgagcgtgggcaaccacatttgaattggccagccgggtgggcaacaaaccaaatggcttccatgggaggaccacttgcagaggccctgcggtcctcttccaactccaattcgtcgtcgccaaccagcgtcttacatcggttgccccgcgcctctgcctccgaagctagcttcatcagcacttgaattatcatccgtatcagacagttccggcaagcttcttatagttgcttgtgtaaatcgctctcattattttactttaactggacgagttctgtgtatgttttaaccaaaacaaatttaacactcattatctcgtaaatgtgcaattgcaattcacttttcaagttaaggtgattctcaaaaaaaaaaaaaaaaaatcgtg

SEQ ID NO: 16538 - DNA, 508 bp, Malus x domestica
  Predicted polypeptide sequence is orthologous to G1868
gcttacatctctaaagatttttgtggttctttcctagacttcagtgatcaagaaactcaagaccaacatccgcttcgccagttcatggatgattggcctaaggaccagtccagtcactcagtctctacttggcctgaagaaataaaatctgactggacgcagctatcaatgtcgatcccaatggcatcctctgagttctcatcatcctcttcctccccaacgcacgagaaacttgcgctctcaccgctgaggctatcccgggagtttgtgcctgcccaaatgaatttgggaatgagcaatgaccttagcgaatcaagccagaaacaaactaattggatacctatcccctggggaaattcaatggggggtcctttaggagaggtcataaccaacaccaccagcagtggcaagatctgcaataactcaacatcgccgcttaacctcttaaatgaagggtgggatggcaactctcagttgggatcttccccaactggtgtcttgcagaagt

SEQ ID NO: 16539 - DNA, 657 bp, Malus x domestica
  Predicted polypeptide sequence is orthologous to G1868
gagaagaaacccaactcaagatgcgcctctccttctctgtcatccaactctctgaaccttgttcttcctcctcttcctgctcatgaactcaacgcccgcagaatggccgaggtgtccggaatggattttgggctgatgggtttggagggtttggtgggtcccgaagccggaggaggagaggcagcgggaaaagttggtgacggatctggctccgcctccgccaagcagcaaagatcttggccggtggacgacgactggaggacctcaaaaatgccgaaaaacgaagatttgaatgcttccaggacaatgcccttgcagtaccaggggacacctctgctgagatctaattctcagctgcttcctcctccagctgagactcacaggcaggagcaaatgctgagcttttctaacaacaaatcagaagtcagttttctcagcaaagatggagactttgcctactaccagaggaatcccactcccattctctctccttacccaaggaatgcaggctcaccaggttatggaagcttgaatctgagcatgcatgggcctttgactggggctagaggacccttcactccttctcagtggattgagctggagcaccaggccttgatctacaagtacatgacttcaaatgtgcctgtcccttccatc

SEQ ID NO: 16540 - DNA, 571 bp, Malus x domestica
  Predicted polypeptide sequence is orthologous to G1868
aaatcattttgcttttttgggcagcctcctttttctccttgctccttgctttccccaacctagaatcctcatcctttccccaaatgagaaatctgaaatccacaacccaaaactcactcatagtagcccctgccttgcctcattcctcatatcatatcctgatggttcattctctccattcgattcgatttcaggcataatagtgggagttgagtaatggagttgctgccatgcaatggagtatagcaggaggcaaaggacctttcactccatctcaatggatggagctagaacaccaggtcttgatctacaaatacatcccaatgtgcctatttcgtccactctgctcatcccaatcaagaaggcccttaattctgcatgatttttgacattttcgaatggaattcccaggcccaattcatgtaatttcttcattttactcaaaggaaaatgatttccacacactttttttttcttatgcatttttttgcttattttgtcgcttgatttttgcttgattttatttaattcaaaagctagaaataaatctaaatttttcaaaaaaaaaaaa

SEQ ID NO: 16541 - DNA, 318 bp, Malus x domestica
  Predicted polypeptide sequence is orthologous to G1884
agaattgacaatggcactctcagatcttgtttgggaggatatgacagcaggtccggttggtacgcagaggactgctgttccttataccgagtaatcagatcaggaggcagaaggaaggcgtgttctcgcatctaagctgcctcattgatcattacccctggtgttacaaatgctttgtccatgctccatctttggtttctttgtttatgaagatggagagaaaatgattgaataaaatacttcagaaacttttcttggaatgaaaatcttttagcagaagatatattggaaaatatgggaaaaaaaaaaaaaaaaaag

SEQ ID NO: 16542 - DNA, 456 bp, Malus x domestica
  Predicted polypeptide sequence is orthologous to G1884
ggatatttcaaggaattcacaagctgaccaacaatattacttttttacgatacatgaacaagattgggactacaaagtggaagccctgaaaaattccgttctgaaatcggagctctctcgccagtgattcgatcagttggcattggttgcagacccatttgtcatacacacttattggttgtagacccatttgtcgaggctcaaagaaaaagaagggggaaaagtgtattcttgccatagattttctgttggcagtgagccttgaagaaaagggaaggtgattacagcggatgaggtggctttttgcttttggccttttgttttcttcattttgctaaatgtggagacttgagaaaagaacttctaatgttgaaccccaattcgatgtgaaaacataacctaatcatgttagcatacaaacttgattgttattttgttcacaaaaaaaaaaaaaaa

SEQ ID NO: 16543 - DNA, 740 bp, Malus x domestica
  misc_feature (709)..(709): n is a, c, g, or t
  misc_feature (718)..(718): n is a, c, g, or t
  Predicted polypeptide sequence is orthologous to G1902
acagacagattttctttctccttcctcctccatctttcactctttgatttcacacacatgagaacatttcccagctgaaaaactcgggctttctgaattctgcgttaaaatttcaaaaatccaatctctttgggttttctgctttgttttttagtatggtttttctcactctctctctctctctctctctctctctccacccaacatgaaagttcgaagattgtaatttttggatgttttcaatgaaagctcatatctgggtctgagaaaatatcccacctttctgtcttcttttcaggtttctgcggatttctctgctgtttttatttagcctcttgacagtctcaaaggtatcaagtatcaaggctctgaaaaccccagttcagatccccactaaccttctggttttcagttcccactatccaatctcaaccaaaccctccaaattccacaaacttcattctcttttggtctctaatcagacttcgcaatctgatatctgatccaaaaactccgaatttgtttctataaacaaaacccagatcatcaaatcttccatttttctagactttggttgacaatacgaacttggggtctcaaaaaatgcaggaccctgcaacttttcagcccatgaaaccccaatttccagagcaagagcagctgaaatgtccgcgctgcgagtcttccaacaccaagttttgctactacnacaactacnacctctcgcagccgcgccactt

SEQ ID NO: 16544 - DNA, 494 bp, Malus x domestica
  Predicted polypeptide sequence is orthologous to G1927, G2184
caaaatcaaagtggcaatgaggctgcaggtgctacaagtcagttctcttctgctctttgggcatttgtggagtctatacctaccactcccgcatctgcttcagagagtgctttggtgaatcgtgctttcgaacggatgtctagcttcagtaggttgagaattaatacggcaagtacaactgtcgcagcaggtaatggttctgaaactatgagagcaggcataaggaggggattcttcttccttccggttcttgtagcactatgtgccattttttgggttttgatggcaactctcagaccgccggggagatgcctccccgcttgagtctgcaagtgggaagttttgctgctatacatatatatataacatataattatttatattcatcgtcggaaagttgatgggaagtgatttcaaatcattatgaaaacataggattctaatatctatctgaattttggttgtagaggatgaaaaaaaaaaaaaaaaaatgc

SEQ ID NO: 16545 - DNA, 651 bp, Malus x domestica
  Predicted polypeptide sequence is orthologous to G1928
ctctctctctctctctcatgcaagacatacacatgtcttacaattaagctttctgtttatgacacaaaattacttgttccaaattaccacatagggttttttcttgaatttttcttggtgtttgtctgcaactccagtctcaccagcaaaccgaagtggctcttgcagacataaatttaatcaagagaaagggtttgaagttagagagaagataaatcatgaaggctagctagggaaaacagaatattggtgggatttgtgtgaagctgaattcatctgttcacattcttttacatatatataattcttttctgaactagggtttgcagtcagatctaaatcctgtcacagatgcgaaagttgagatctgttgctcaattcgttcatgaaactgtatacaaacaattgatgtcatcatatcctataatttaaagcaaagggtgttttaatgatgaataaaggtttgatggtggatgagaatatgtcaaatctgacttgtgcttctggtgatttaagtgcttctaactcaagcatcagaaatgagtcatcttctgctggcacagtctaccctcatcccgcatcctcagcacaaattcagcagcagcaagcaccgccaccgccaaagaagaagagaaatctcccaggcaaccc

SEQ ID NO: 16546 - DNA, 1974 bp, Malus x domestica
  Predicted polypeptide sequence is orthologous to G1928
ctcttcaccacaattggaggagaattttctgggttttgtctacctatagacttacaacagatcccttattttctgttcaatttctcattaatttaatcaatttttgaagtagtagctatagagagagagagtgagagagcaccaagaacaagataagtggggaaagaaacaaataaggagagtctggaagtaagacaaacgagtgagaaaaaaaatctatcttccttttacctttatcttccttcaatgtcaattatcacaggtagtgctgctactgggagtttctcttcaggaaatacaggtggagaagaagttcaacagcaacaacaagagctattaaatcaccatgcaaactttcatggctccaactccctccttccaacaacacctaatatcaatagcaatggtatttccactactcaagtacaaaagcaacctccaccagctaagaagaaaagaaacctaccaggaactccagacccaactgctgaagtgatagccttgtcaccaaagaccctgatggccacaaaccggtttgtatgtgaaatttgtaagaaggggttccaaagggaccaaaacctccaactccacagaagaggtcacaacttgccatggaagcttaagcaaagaacgagcactgagatcattaagcgagtctatatctgccccgaatcctcctgcgtccaccacgatccatcgcgggcactcggggatcttacgggcatcaaaaagcactttttccggaagcacggcgagaaaacctggaaatgtgacaagtgctccaagaaatacgcggtgcaatcggactggaaagctcatctaaagacctgtggtactagagaatacaaatgtgactgtggaaccatcttctccagaagagatagcttcatcacccacagagctttttgtgatgccatagctgaagagaacaacagaaaccaaggagtagtaccaatgtccaacaatattatgggagcaccaaaccaaggccaactttccaacagtgagctcatcatcccggcatcaccgcccatgaacaacaaaatcaccgacaacccatcgtcagcaagatcagatactactacatctgatcaatttcatcataattttgatgccaaaaatgcccctttaaccctagaaccccaacaacccttcccaatgcccacaaaacccgtaaacatgttaccgagaaccctaagcaacaacacttcatcatcaacatcaccatcgtcactactgttcggattaaaccacggcgggcacgatcaatcactcatccccaactcatcaggccatttatccgccacgcaactgctacaaaaagcggctcaaatgggtgcaactatgagtggtggtcccaaccctaaccctagtggtacaaccataacaagcatggcaccctcaacctatggtacagctactggtgggtacaacatgaaccccttcatgcagcagagagatcctaataacattctgcaattagagacctcgccgcagttttttggcgctaattatgcgcagatggggatgtttagcgggatgttattcgatcatgctcagaacaatggtttgttgaagaacatggagcatgaaaataatgggacttcaaataaaatagggttcaggggtgctagtaatgtgggtaacggtgatacgttgaccgttgactttttagggcttggaggatcgggtaataataatagaccagaaaactttcatgatctgcagaaacaacaacatggccagcaagatcagttggggttcggaggaattgatgatcatgatgatcacctaagaatgcaaagatttggatgatcatgatcagttggtcatggatgaatgataagcgtggttaattaagtgtagttttttagttttactatctgcattagctaggttttcacatgttatgatctccggtgacaatttttagtttcagcaaacagaaatgaactgtttcggtcgatcttcttt

SEQ ID NO: 16547 - DNA, 466 bp, Malus x domestica
  Predicted polypeptide sequence is orthologous to G1944
ttttttttttgatcgagaaagatgagtgaatacgtctcaaacaacttcaaatcacattacatcaatccaaggaaaggcagattcggtcgctaatattacatgatcaaactactctagatgtcacaacaggctgccgaagcagcactaaaagccttcctacgcggctaaattaaagaacacctcaaatggggttgaaccctgcgacgatactagcagtcaagtttacagacaacaacaaacaaggacaagtgagatccaacggttgggaataggggagcttaattgccaatgtggtcagtgagaaacctcatattgcaactagaagcacttactcttcacattacacctcccggcaaagatacattaatgtcagtcttgttttttggatctgatgccaatgacgaccaattatctccacggaaggcagtcgaggatgagaagtttgattttgggtcggcacttgaaa

SEQ ID NO: 16548 - DNA, 677 bp, Malus x domestica
  Predicted polypeptide sequence is orthologous to G1946
cggcaacaacagatgatgtcattccttgcaaaggctatgcatagccctggtttattcactcaatttgtacagcaaaatgagagcagtaggtgcataactgaagtcaacaaaaaacggagacttaagaaggaaggtattgctgagagcgagcgttctaatactcctgatggacagattgttaaatatcatcctcccatgaacgaagcagcaaaggcaatgctcaggcaaatcatgaatagagatatatcttctcggttggaatcttctaataacagttttgataacttccttattggtgatggttcatcatcatcatccggtgcagtagacagtgggagttcttcaagccgcacatcaggagtgactcttcaagaggtcccgctaacttcagggcatggcctgccatctgtaatttctgaaacacattcttctccacgggtcactaactctggaacagttatgagatctccattctcagacgtcaatgcccttgttggagcgcaagagtccccatcaattcccatacctcagacaaatgtaattatcccggagctatctcaaataccagattttccacccgaaggcttagtggatattcctgaagaaagcatggcaggtgaagacactggtgttggatatattgaaaacatggcgtctgaagcaggtgatggatttat

SEQ ID NO: 16549 - DNA, 638 bp, Malus x domestica
  Predicted polypeptide sequence is orthologous to G1948
cacgaggcttccaccgccttaaacccaccacctacaccaccaccaagcccaccaccctcataaccgtctccgccatccaaaaccaacaacaaacccaatccatcgaaacccataacccacttccgctcccagatgccaatgaacccgacgaaaacgacgaatcctacggagaggtagacaaaatcatcggaagcagagcgctggtgggcggcaaggggatgcagtacttaatttcctggaaagacggccattcgccgtcgtgggtcccgtcgggttccattgcgaaggacgtggtggcggagtacgagaacccgtggtggaccgccgccaaaaatgctgacgaatccgcactgagtcagctcatagctgccgaggacgactcgcgcgacgttgacgccgttgacggggatggccgcactgctctcatattcgtctcgggtctcgggtcggagcagtgcgttcgggttctggccgaggccggagccgatttgaaccaccgcgataacggcgggggactaacagcgttacatatggctgctggttatgtccgtcctggtgtcgtcaaattattggtggagctgggtgcggatcccgaagtggaggacgagagggggcggaagccgttggatttggcgcgg

SEQ ID NO: 16550 - DNA, 571 bp, Malus x domestica
  Predicted polypeptide sequence is orthologous to G1950
ccgctccctcctccacgtcgctgtctcttcaggtcgctccgaggtgatgaagctgctgattgatgctgatgaatcaacgagtgtgataaacagcacggatgaagatggatgggcgccgcttcattctgcggccagcattgggaattcagaaatagttgagctgttgctaagcaaaggagctgatgttaatttaaaaaacaattgcggtcgatctgcccttcattatgctgccagtaagggatggtttgaggttgctcagagtttgatctcccatggggcaaaggttaatctgaaggacaaggttggttgcaccccattgcaccgggcagctagcactgcaaaatcacaactgtgtgagcttttaattgaggaaggggcagaggttgatgctattgatagagctggtcagactcctcttatgggtgcggtgatttgcgataacaaagaggtttgtctccttctaataaggcacggagcggacgtggacgtggaaaacaaggaaagatacacggtgcttggtcgagcttctaaagaatttagaccacttttgatcgacgctgctaaaggcatt

SEQ ID NO: 16551 - DNA, 459 bp, Malus x domestica
  Predicted polypeptide sequence is orthologous to G1950
ttttttttttttttttttttttttttttttatttcaaatcaatcgtacatttattactgcgttatcaacacaaaataccgtcacgttgacgttacaacgtaggtttagctccgtgataggcgtttatttcccggctaaactcgctctttttcatgacgcaagggttgaaaaaagcagggtggttcttgaagttgaaacggtccaaattggtgggaacaattccctccaagctcttcacattggcccgagctccatgagcaaccagcaacagagccacctccacgtgccccgcctccgccgcgcagtgcagcggcgtgtaactggcatcgtccacggcatccaccagagcaccatgattaagcaacaccttcacacactcgatcctccctttgaacgccgccctgtgcaaaggggtccagccattctggtccctcccgttcacctctgccccctccgcaa

SEQ ID NO: 16552 - DNA, 717 bp, Malus x domestica
  Predicted polypeptide sequence is orthologous to G1958
gcaccgccagtgacggaatttctgcgtgaaccggggctcgttatctagatataggcaaaaattgatgacccctttcggtggttttgctgtcaataacaagcaaaaggtgcgcagtcagtaaggttgaagttggactatagatggaggcacgccctgctatgtccatccggagatcagctgcaaatcagcttactcatatgggggtccctgcagcaatgtcttcatccttaccagtccttccaacttctttggaagagacacatcccaatttaccagactcccaacaggtttccatggaaagagaacttatgacaaggcctgttgtgcatgctggtcacttaacctccaacagtggagtagttggtcacatattttcatcatcgtcgggattttcaacagatcttcactactcaactcattcacctcatgaaaaacagcaaaaaaactctcctttcatttctcagtctcctcattcgggatttcttcagtcaacagaatcttgtccttatcccaaagaaaacagtggttcctggtgtacagatccactgccaggtttccttgattttcctgtaaataaccatatcgagaatagtcaaatagagagcagtagttgtagcggcataatggctgctgatgaatttgttaagcgacatgattggcaggaatgggcagatcagctaattactgatgacgatgctttaacttctaactggaatg

SEQ ID NO: 16553 - DNA, 663 bp, Malus x domestica
  Predicted polypeptide sequence is orthologous to G1958
cgttgctgtcgccgttgctgtcgaaattgggagcttcccggtgatgttgatgcaattgatcctaaaccaaagcagtcccagattcaacaacatcagctccagattcaacaacatcaaccccagattcaacagcatcagccagtacaatctgtagaatttcatcctggtcctgagccgttgtccagtgcacctccaaccaaagccagaatgcgttggacgcaagaacttcatgaggcctttgtggaagctgtcgaccatcttggtggtagtgaacgagcgacccctaagggtatcttaaacctcatgaaagttgaaggattgacaatctatcatgtaaaaagccatttacagaaatatagaacagcaagatacaaaccggagtcatctgaaggaccatatgagaaagtttcaactctggttgacgaaacaaatcctctagacatgaaagggagcatgggtattactgaagcattgcggttgcaggtggaactccagaagcggcttcatgaacaacttgagaaccaaagaaagctgcagttgcaaattgaggaacaagggaagtgccttgagaagatgtttgaagcacagagaaaattcgaggaaaacagggtcaagtccggatcatccaccgtggatgaccactccaactccactatccaaaaa

SEQ ID NO: 16554 - DNA, 581 bp, Malus x domestica
  Predicted polypeptide sequence is orthologous to G2010, G2347
gtaaattctgatacgtagacttccttaacaatggagggcaaaaattttgaaggaaggcaaacatggaaagagaaatcgaagaaagatgttgaggaagtagaggatgactactcggacgaagaagagactggtggcggtggtggagggttgatgctgagatttgaagaaaatgagaggcagaagaaagctgctgcagctggaagaagaggatctggtggtggaggtgaggtggggggtttcacagccatcttgtcaagcggaaaggtgcggggctgatttggttgatgcaaagaggtaccaccgccggcataaggtttgtgagtttcattcgaaggcagctgttgtgattgtttccgggactcgacagcggttttgtcagcaatgcagcaggttccatgagctaatcgaatttgatgaagcaaagagaagctgtcgcaggcgtctggcaggacacaatgagcgacgccgcaagagctcaggcgaaccttatggagaaagctcaagccggaagagtggttggtcaccaatacaaagaaagtcagactagatatcagatcacgcccccagaaactcttcctcca

SEQ ID NO: 16555 - DNA, 674 bp, Malus x domestica
  Predicted polypeptide sequence is orthologous to G2035
agatagtgagcgtcttgctgagctatacggctattgatgtcaacgtcattaataatcattgcgaaactgcaagggatttggcagataaactacagtatggagaatctaaattagaaattacagaaacactggcggaagctggtgccaagtatgcaaaacatgtcggccaagtggacgaagcaatggagctgaaaagaactgtgagcgatatcaagcatgaggtgcactcacagctcatacaaaatgaaacaacccgacggcgagtttctggcatcgccaaagaactaaagaagcttcatagggaagctgtccagaacactaccaattctatcacagtggttgctgttctgtttgcatcaatagctttcttggccattttcaacttccccggccaatatgtacagtctggaccggaagcagggaaggctaaaattgccgatgaagttggtttcaaagtgttctatctattgaatgccacctctctcttcatctcactagccgttgttgtggttcagatcaccttggtggcctgggacacgggggctcagaagcaagtcctgtcggtggttaacaaactaatgtgggctgcctgtgcttgcacctgtggggcgtttctgtccatagcttatgttgtggtccgaaaagggagttcatggatggccatccccataacc

SEQ ID NO: 16556 - DNA, 639 bp, Malus x domestica
  misc_feature (393)..(393): n is a, c, g, or t
  Predicted polypeptide sequence is orthologous to G2035
gttcagatcactttggtggcctgggaaactggggctcagaagcaagtcgtgtcagtggtgaacaaactaatgtgggctgcctgtgcttgcacctgcggggcatttctgtcgatagcttttgtggtggtcggagaggggagttcatggatggctattaccataaccgttgtgtgagtgcccatccttattggaactcttgcaagcatgtgctactttgttttcagacatcactttggggctttccggcgggactctcaaaggcgcatcaaacgggccagtggaagcaagtccttctcgcggtccttctactcggcaaatatctcagatcttgatgatgaatataactccgaccgtgaaaaaatctacgctttgtaaacacggatacaccatgtnggggagttgtttacttgtttatctgtcgaagtaacagttaatgttcatatttgaagaggtgctctgctgtaatctttgcgcgcgccaacggtaataaacagttgattgtagattatgtatattgtacttgtaactacaggtcacattcgatcaagacttccgcagctccctaacgaaaccattttatatggtttcacatacttccacttcctccgaccaagtctctgatgcgcttcaagtgcgtct

SEQ ID NO: 16557 - DNA, 265 bp, Malus x domestica
  Predicted polypeptide sequence is orthologous to G2060
gatttggtggaagttcctcaagggttgttggggcttgatcttaaaggaggatttgacgaaaaacgaaaagagctttcttgatcctccgggatttgcttgggagctttagagtttcaaagcttcagggttttggtgtgatgtgaattcatccctgaaaatgaatgccttggcttcctatttatagaattccaaaacttgatttttggatttaaataatcaaaatgaaataaatcatttatgccaaaaaaaaaaaaaaaaaatgcgt

SEQ ID NO: 16558 - DNA, 473 bp, Malus x domestica
  Predicted polypeptide sequence is orthologous to G2094
cgggatcagaagcacgaagaagaggacagctattttgggattaaacaaagaaaatcccaacgataaaaagggcaagaagaacaagcagctcggcgacggcttgaagcagcggctgttggctttgggaagagaggttttgatgcagcgatcgacggtggagaggcagcagaggaagctcggcgaggaagaacaagcggcggtgctgctgatggccctctcatatggctctgtctatgcttagcctatgttcggattaatattaagctataagtaataagtaattaattagggagaaatggcaattctaacctccatttttcagtgtaatttcacccccacccctcccgttttcttgcctcttttattagtggaaatttactttgttctttatttttgagagtgattgagcaaatgtaagaattttggaagatcttgttctaattttgctgacataattctactaaaaaaaaaaa

SEQ ID NO: 16559 - DNA, 619 bp, Malus x domestica
  Predicted polypeptide sequence is orthologous to G2094
ttttgttcgctcttttttcactgtgctttttcgaaaagctgctataagcactttcggtctcagcttctgagttgtgatcgatctctttccttcttgttcctctgtttttttccatagcttgggttcgctgagtcactaaagtttcttacttgaccagaaaccattcgatcaaattgatcgctacccagttcgatttcctactcgttctcaactgggtttgtctcagatcttcataatatctcatacagaatgttggatccaatcgataaaggatcggagtcagaggaaatgactatcaaaaccccagatgccggttcctcggaggaaggctttaagaaaacctgcgccgactgtggaacctccaaaacccctctgtggagaggcggtccggcgggcccaaagtctctctgtaatgcgtgcgggatcagaagcaggaagaagaggagggctattttgggattaaacaaagaaaatcccaacgataaaaggggcaagaagaacaagcagctcggcgacggcttgaagcagcggctgttggctttgggaagagaggttttgatgcagcgatcgacggtggagaggcagcagaggaagctcggcgaggaagaacaagcggcgg

SEQ ID NO: 16560 - DNA, 653 bp, Malus x domestica
  Predicted polypeptide sequence is orthologous to G2116
ccatgatcaaccgatccaaggccgaggccaaggccaggttcaaggctaaggccaaggccaagtcgaagtccctagccggacgaggatccggatcctggcaggggaagattccaggccaaccgacgaagcccggagatggccctcctactcaactcaaaaatgaaaaggctgttgaaaagaatctggctaaagtccagcttgacaaggagaatactactactccaaaaccaaaaccagaaaagagaaagagcagaatgggtagaactttcctattcacagacccttgtcgaatttgcaatgtgtttgggcactggactgatttatgcccctacctgaaatttgtcccatacaacgtaactaaggttggcaagggctatgaaatacatgacggccgccatgggaggtatgctgctccgatttattgtcttaactgtacggtgccggttgaacacgaggctgaaaagtgcccgtacgacagctgatgcatggcagtaatccagggccatcatggttcgcctccttccacccccataatcttgccgatggcgaggaaggtgttggattatctagtcttggggtgttgctttcctctttacttgctttgagtttcagcactctgtagtctgtacgtatgtctttgagtaagctcaccc

SEQ ID NO: 16561 - DNA, 540 bp, Malus x domestica
  Predicted polypeptide sequence is orthologous to G2142
cgcattttttttttttttttttcgcacctgaacggctccatttgttacactcgaaacaattgttctcggcatgtgttcaatgaaatatgtaaaggggaaaaccgaggcacggcatgtacactaaccggaagatgggcactaagacatcccaaagcagaataaaggagtaaaaatatgggtgaaatgggagaacaaggagatgtcacactggttctacgtcttgaggcgcttatgggcttgatcggagtcctctccgctgccagcatccctaaaatgcgccgtcgtctgattgcttgagtggggattatcattatccttagaggcaggtgttacaaagggcagccctcggttcgcacgattcccaagatcaatctgcactgagatactagcctgcgacagatcaacacccgcactctgtagcgcttgactcaaagagtttaataacccttgcaagtaaacgcttgagatgcttattgttccaccttcaattgtcacctcctcctgttggctcagtacatcactaccgctaatggtggggca

SEQ ID NO: 16562 - DNA, 524 bp, Malus x domestica
  Predicted polypeptide sequence is orthologous to G2144
ccatccacgtcatgatgcgttaaccgagggttgttccgtggtttttacatagttggtatctttggattgtgcgagtgtcactcctttgcgagatagacctgtagctttagctcctcaatgcccatgcttgtctcctcgacattcagatgcttctgaagaggcaggagatgaaggtgactcgcacgaagatggatttattttgcagcagcgttaacaagtttcaaacaagcgaccatttgaggatgctcaggctgacagtgatgtcaattttcgtcacaagaagaaagaagtgtttagacctcctcaattcgatgaccgtgcgccatttgagagagatgtatgtactttattttctctcatgatttcttctgcttttatgattttggcttttgtttctaacatctttctttggtgtctttacgttgggccttcctatcattttgatttggcaattgcagatgtttattcctatacggagatgctatttataggcggcctaccttacagatagagagatcggggat

SEQ ID NO: 16563 - DNA, 491 bp, Malus x domestica
  Predicted polypeptide sequence is orthologous to G2144
cgtggcttgaccgcgacgagctcgaacatgaacgtacggcatcttctcggcgtcctctttgatttcggtcttgcacttcttcgtcggggccttaatctgaatttcacaaagtcagaggggttcaattcgaattttatcgatcacttcgaaaattcagcaaaatttccgaaaagggaatcctagaaaccctaattcgacgggaattaccttcttctctcgctcctttctcttacccgaggtcctctggttgtttttggtcaagtcaagcgtcagctgcgacgagctagggttcgaatcggtctcggccggctcggtcttcaccttctccaattcggcgccggagttcgacagcgcggagtttgtatccggcgagccatctccggcgaaggtcgagaacttggcggcgcgttcgattggggcggggttggtagggaaggggaggctcgaattgaaaggaaggtgctggacgaagggcgcgtgttgggggtcgc

SEQ ID NO: 16564 - DNA, 625 bp, Malus x domestica
  Predicted polypeptide sequence is orthologous to G2144
ctcagacaactcaaagaaataacattttgaccgccatagccatctctctctctctctctctctctctctctctctctctatatatatatatatatatatgtatacccacttgcccaatttgcccaaattgcctagctttacccatttctctctcacacccaatttcagtcacaaagaccactgttcttcccgagaccttaatcaaattaccgggcttttgcttaattgatacctacactttgtccgagttgagaactttgagaaatttgtcacggaattgagctctgtttcagttcaatttgccgcccaattcaatggacccaaccggagcaaccgtacccgaatccactttaccgggacccgagctcgagtccctccaattccgggaagaaattcaccaactcatgaccgtgccgcccgagaacgccagctccttcaccgcgcttctagaacttccgccgacccaagccatggagctcctccacctctcgccggaacccgactgtgctccgccgctggccggcgtctccgccgacccccaacacacgccctacgtccagcagccccctttcaattccagcctaaattttccctaccaattccgctctaaccgaacgcaccgcca

SEQ ID NO: 16565 - DNA, 618 bp, Malus x domestica
  Predicted polypeptide sequence is orthologous to G2144
ttggttctagatgaaatcatcagtcacgtgcagtccctacaacgtcaagttgagatcttatcaatgagacttgcagcagtcaacccgagaattgatttcaactttgatggtctattggttgctgaaagtggatctctgatggaaagtaacttcgccggtatggttacacctctgatgtgtccggaagtcccaatcaataggaacagacaaccgtatcaacagcaatggcactttgatgcgcttcagcagcaaggttgggggcgggaagaagaaaatcacactttcattaccccagaaccctcctcatcagttggggctgttcagcaaactcagcaactgcagacaagtcacctggagatggagatgtgaagacgtaattaagttgtactagtagaaatgtgtatataaagtatagtattagcagttagcaggtagtagatgaaatgtctcggtattcatggccgagtttctttgttctctatttttcagggtcagttaagaacatcccgatttgcctcgcttcgagaggaaatagatttggtatgttatccggataagtatatatatacactaactctgagggtcattcaatctaattacctattttttggaactgat

SEQ ID NO: 16566 - DNA, 507 bp, Malus x domestica
  Predicted polypeptide sequence is orthologous to G2213
tttccttttctcaacctttggtttccgatcttctcatctttctcatttttctcagccaaatcatctgtgcaaatttcttgcgtttaaaacccttggaaaaataaatagttgctgcatcttgcgtttaaaatccctgggttagtactgattttgttggtttttcgactttatcagggtagatttgttacctccaaggtccacctctgtttggtggacactttgctcttcgttttttggggcttctatgtgcagcttcgaacccgtttatgctcaagaccataatttttaagcaacaaaattaagctggaaattaaattgaggtatgaatgcttccacttattcagcttccaggatctacagttgccatgcctttgatggataaaacatggaggacccagctactactcttatagagcttctttagcattgtaatgccattcagagtggttcaaagaatttcaagagcttcattcatctaatttatgcttttcatgtaaaaattaattc

SEQ ID NO: 16567 - DNA, 688 bp, Malus x domestica
  Predicted polypeptide sequence is orthologous to G2226
taaaacaaaatatatatttatatgctgattgtgtgtgtgtgacagctgcctaaaatccctagaatcccttcttcttcttcttccttcagctcctctggtcggtactctgtttttataaggactgaaaaagcttaaaagctccaaaagtcttcactctgtcggataacaccaagatatcggtgacatttcaacttcgtttgaattaatctgtctcccgtttcgtgtctttgccggttcattctggtttcactgtccctcaacaatcttttactgattttagctttgagtttggatattccggtgtttaccatacatttatattcacaaatccgaacccccataacatcggttttgttcaaatgggtctctcaagtctaccagctccatcagaaggagttctatgtgtgcttttagtaaacacagccctatcagtctccattatcaaggggataatccgatcagtcctgcaagtcgttggtatccgtctcacatcagcctcgtcatcttctttcccatcagaagactctgctgaaaacctctcagaatcatttgagttccatgtcaatccttcggctagttacattgaggacatcaggagccatatcccagcaattcggtttgatgctgtgtgtagcttcaagcagcaggaacacgaatgctctgtctgcctaaccgagtttgaacctga

SEQ ID NO: 16568 - DNA, 722 bp, Malus x domestica
  Predicted polypeptide sequence is orthologous to G2226
gtttcgcgtctctgccggttcaatctggttccactgccccttacaatcttggcaatccgattcgagccagtggaacttagtagttttgatcacatagaggtctctctagtctaccagctccatcagaaggtgttctatgtagtgcttttagtaaacactgccttatcagtctccattatcaaagggataatccgatcagtcctgcaattaggttggtatccgtctctcatcatcttccccgccgttagcagactcctctgaaaacctctcagaatcatttgagtttcatgtcagtccctcggctacttacattgaggagatcaggagcagtatcccagcaattcagttcgaatctgtgtgtagcttcgagcagcgggaacacgaatgctcagtctgcctaaccgagtttgaacctgaatcgaagatcaaccacttgtcctgcggccatattttccatcaaaattgcttcagagaagtggttgaattactggaacatcacatgccctctttgtaggactcctttcatgcccgaggaggacgcaccctgcttctgggtgaagggtttacaaagcaagaaaatcgcgatgaatgtcatgtacagcgtttaatgtacaggtatttgacaagaatgcatcgcctgccattagtgttgttaactatgttatgtgcgagttaaaccgtggtatatgtccatcagtctcagagaccacatttttactatg

SEQ ID NO: 16569 - DNA, 703 bp, Malus x domestica
  Predicted polypeptide sequence is orthologous to G2227
ctttctctctcttccccttcagatctctaaacctcatggccatgccttcgccgccgccgacgacgtcgtattggtgttacagatgcactcgcttcgtccgcgtgtttgctctggactccgccctcttgtgcccccactgcgaaaccggcttcctcgaagagatcgagacgatgccacagccgctactgcagccgaaccatctccgccgtagattcccgtcctcccaccgccacgaggaagaacggggccaaaacccgactccgacctcccgccgggtacgacgggcctccggcgaccggtcttctctattcaacccggtcatcgtcttacgtggcaccgaggccgataccgagtccaacacattcgaactctactataatgacgccgcggggtcggggctccgaccacttccgcccaccatgtccgagcttttaatgggttcgggcttcgaccgcttacttgaacagctctcccagattgaaatcaacggtttgggcagacctgaaaacccgcctgcgtctaaatccgctgtggaatctatgcccgttattcaaatcgccgatacccacgtcgggtcggactcgcactgcgccgtttgcaaagaagcattcgaactcgggtcggaggcccgagaaatgccctgcaagcacatataccacccggattgtatcctcccctggctctcaatgcgtaactcgtgccc

SEQ ID NO: 16570 - DNA, 529 bp, Malus x domestica
  Predicted polypeptide sequence is orthologous to G2239
ctcggcggcggagagagatgaccaggtaatgctagaacgaccacaacaagaacctgagctgttgaacttaaaccagacgctgaatcggaaccgtacacgcggatcgagatcaagcaggttgcttagattgttcccgcggtcgcactcgaccggacactctcttgtccaaccgggagaagacactgagcggttcaccttgagactaccggttgaagtgagaaaacagatcatgaatcggaagctgaaccggtccactagcttgttggtcttgccccgagaagggagttcgaggcgtggtcctcgaaccggcgagagtggcagtactaatagagtgaggagctacagaaggctcgagccattggaccggcaattcaaatcggaccggtgggtgttctccaaaacgccgacgtttctcacgaggatgtcgagtctcttgtcgccaaaggtggcggtaagtgacggcgagaagccgaccgagccagcgatgtcgaggagtagctccgctcggcctccggtttaattagttttg

SEQ ID NO: 16571 - DNA, 372 bp, Malus x domestica
  Predicted polypeptide sequence is orthologous to G2290
cgttgctgtcgaatttccctaagaacctatgtatgtgctgaggagccgccctcttagatttccagagattggatattgtgccaggctgtagttattttgctgcaaggaaactcaagatattcggagatgcaagtgcttagtttatgacgtgtcttctacttcatctactagaagaactccacctgacggaaaatttggagtcctgctgcatcctttgttcgtatgaatagataagactataacaagagaaagaggattttcttaatgtgattataaggtattttggatatttttaatgctgaatcctttggaaaggtttgaataataaaagccgttttggccgttttagatcgcttaatccaaaaaaaaaaa

SEQ ID NO: 16572 - DNA, 674 bp, Malus x domestica
  Predicted polypeptide sequence is orthologous to G2311
aaaacgtgaaagcttcttcgcggcagtcacaggctctgtgctgctgagagggagagagagagacggagggagagagagatgggtaatccgaagcaaaaatggacggtggaggaagaagaagctctgagagcgggggttaggaaacacggcactggcaagtggaaggacatccagaaggaccccgagttcaaccccttcctctcctctcgctccaatattgatctcaaggacaaatggaggaatatgactgttagtggcacgggtccccgggaaaaatcaaggccaaaaacaagaacaaaccaagatgttactgttgctccagtgtctgttccccagacttctgctgctgctccagttagatgcgattcaccagcagcagcagctccagttagacgtgattcaccagcagcagctccaggcggacgtgattcaccagcagcaactccagtcagacgtgatgcaccagcggcaactccagtcagacgcgatgcaccaacagaaactccagtcagacgtgatacaactcctgttgcggatgattcggctaccggcttatctgatgcaattcctgcaccagtgtgcaatgcaatgatttttgaagctctttcagcctcaacagatcccaatggattggacactagtgctattgctagctatattgagcaaaggattga

SEQ ID NO: 16573 - DNA, 577 bp, Malus x domestica
  Predicted polypeptide sequence is orthologous to G2319
tcacattcattcattcattcagtgaggctttcatgctttgggaagccacatgaactccactgacgccaacagccaccaatcgtcaatgggtatggcgtcgacgccgtcctcagacgggtcagggaagaaggtccggaagccatacaccatcaccaagtccagagaaagctggaccgacgaagagcacgacaagttccttgaagctcttcaacggtttgatcgagactggaagaaaatcgaagattttgtgggttcgaaaaccgttattcagattcgaagtcatgcccagaagtacttcttgaaagttcaaaagagcgggacaaccgcacacgtgcctcctccgcggccaaagcgcaaggctgcttatccttacccgcagaaggcctcaaaaaatgttttacttccgttgcacgcatccattgcttatccttcttcactgaacgccattgcatctacgtattctccttgggatgaaaattccattttgataaaccctccatcagaccaaattctgttgtcacaagaagaatttactaatcttcacggcactgaaggtcttcctgatttttcccaagtt

SEQ ID NO: 16574 - DNA, 631 bp, Malus x domestica
  Predicted polypeptide sequence is orthologous to G2319
gaagctcttcaactgtttgatagagactggaagaaaatcgaagattttgtaggttcgaaaacggttattcagattaggagtcacgcccagaagtacttcttgaaagttcaaaagagcgggacaacagcacacgtgcctcctccgcgtccaaagcgcaaggctgctcatccttacccgcaaaaggcctccaaaaatggtttacttccgttgcaagcatccattgcttatccttcttcaatgaacgcaattgcatctacctattctccttgggatgaaacttccattttgacaaaccctgcatccgaccaaattctgttgtcacacgaagaatttactaatcttcatggaactgaaggtctccctgattttgccgaagtttatagcttcatcgggagtgtttttgatccagaaacaaaaggttatgttgttaatgaggaatctcagcttcaacttgtccagtccggactttgaaccaatgaggaaggtcctggtatcacatgatgtcctacgaaaacagtagctgcaggaatcgtcgccgcgaagctgaataaccctctgtcatgatgaacttcttcgtagttacacccgctgactggtgtgtgttttggagcaaaagtgtagtggttctaga

SEQ ID NO: 16575 - DNA, 581 bp, Malus x domestica
  Predicted polypeptide sequence is orthologous to G2348
agaatgatggaaaatcggttgctccattccactgtgaggatacggagataactgtagatggtaggctgggtataactgcgggttcaactgctaatgagagaagtgaaactgttccgctgttgagtaaaaaagcagttggtaaagccaacttcatcaaggaattgcctagcgtggctaagtgttgcacttccggggaggtcttaaggtctcgctctagtgggatgttcttgagatttcgccctgcactttttgtaatttctgctacagctatctgtgtagggttatgtgcagtcctcatccatcctcacaaggttggcgagtttgcagtatcaatacgcagatgtttattcgacaaattttagatgttaaggctctttttttccctctcccttcaatgtatttcgcaaccccttaatcttctgttcatatatctccgttgtacacaactttctaacactaggttaagacaagcggctaaaacgctttatcttgtcaccgtgtagttcttccgggtgtgcttctgggcgatgtttacccacggcgtttgaggtagtaagatttttttttctaaaaaaaaaaaa

SEQ ID NO: 16576 - DNA, 571 bp, Malus x domestica
  Predicted polypeptide sequence is orthologous to G2348
ctcgtcagaaaactttcaacagatcataactgcttcacagattcaaagattcaactatctattgaactttttgatatccatcaagtcaacaaccatattggacaaagttttacaaaatctggagactctgatggctaaaatggagttgaacagtgcaaataatggcagcattgatgcagatatgaggctattacagaattacatgaattatgcccgtgatcttctttgtcaaaaattcgaaagctctggaaggttggtgaaaaaagaggatcttgtctctcaaagtcaaacctgctttcagaatgatggaaaattggttgctccattccactgtcaggatacggagataactgtagacggtaggctgggtgtgattgtgggttcaacctttgacgagagaagtgaaactgttccgcttttgagtaaaaaagcagtcggtaaagctaacctcatcaaggaattgcctagtttggctaagcgttgcacttctggggaggtcttaaggtctcgctctggtgggatgttcttgagatttcgccctacgcttctcgtaatttctgctacagctatc

SEQ ID NO: 16577 - DNA, 687 bp, Malus x domestica
  Predicted polypeptide sequence is orthologous to G2348
cttgactatttttattgcaatgccgaattttatgtggatgaagttgcttgaagatcctgtatcatatctacatgaatttgttattgtacctgggaaaatgctatccgggagaagcaatattctgatttatctaaacgacatgattttccgtgttgtaaaagacgggacttctgtaataaaaacgaaagtggaggtgcgggccccaaggcttcattacgttcatcctacatgttttgaggctggcaagcccatggagtttgttgcctgtggaagtaatttattacagcccaaatttcggtttctggtatccttctccgggaaatatctggaatatgattattctcctccatcttcccatagtcagattgatggggacactgctagtaatttagaccatcagttcttccagatacaggtccctcagactgaatcagattgttttggtcctgcatttattgagattgagaatgaatctggcttgtccaactttataccggtactcattggggacaaagaggtttgtgcagaaatgaagactattcagaagagatttgatgaatctctctctttgcaaggattacacttttcttctagggtttccctttcaaactcttgtgaagcatcttcaatgaggcacacagcattttctgacattattttagatatagcatggttactaaaaaaacc

SEQ ID NO: 16578 - DNA, 592 bp, Malus x domestica
  misc_feature (342)..(342): n is a, c, g, or t
  Predicted polypeptide sequence is orthologous to G2375
aagaagagagaaggattagagaagagagcagagctgagaggagggatggcctgttaaccactctcttgaacaggctgatcaatcaaactaacttctgactcacactctgaggtgaatagttttctttttctttttggacgaaaggtgaatggttttcgggttcataaacttttgccagcttgagtagcgaaatatgcatcattgatggtttgcgaagatgtgctagactgaagttatcgtgatttgtaaagttgggcttgttggtttataaaatgttaccttggtatacaagtttcgttcggtagacatttataagatactgtgacttcgatggaggaccanaccacgcttttacatcgatattaagaggtaaaattgcttacccttctatttgctgctcctggcagagtgcaagggtttgttgtgcatgcttcttgttcaatacacgaaaaatctgtcgttgtctctgtttttgtttttcgatttcttcctttcctggtttttttgaattggcggaagtgttatttacggaaggtatggaaatcttgagatagatggatgaaatatcttttgtaacactagcatatagatt

SEQ ID NO: 16579 - DNA, 706 bp, Malus x domestica
  Predicted polypeptide sequence is orthologous to G2379
ggtcattaccctcaccgacaactcccactcccaatctctctctccaccacctcggcacccaaaccgtatctgtccatggaccgcccgacccgtacccacgccccggcaggccgcgacgactgttggagtgaggacgccacgttggcgctaataacggcctggggcgaccgctacctccatttaaaccgcggcatcctccgtcagaaagactggaaggaggtggccgacgccgttaactcccatcagaacggcggcgccaagccgttcaagacggacgtccagtgcaagaaccgcatcgacacgttgaagaaaaagtacaagctggaaaagtcgaagcccggcccgtccacgtggcccttctaccgccgcctccactccataatctgctcaaccccctcaaacaccgccggtgcgaccaaaccaaaccccccaatcctcgctctcactgccaaatcccccgacccgaatacgaatcccctcggagggtccaccgacagctcaattcgccgcgacgacggcggtgatgaggcggcggtgttttcgggtggggcggcgtgcagggaattggctagggcaatttcgaagtttggggaaatgtacgagaggattgagaattcgaagcggaagcagatgatggagctggagaaaacagagatggagttcgagaaggagctcgcgttgcagaagttgaatatgttcatggatg

SEQ ID NO: 16580 - DNA, 306 bp, Malus x domestica
  Predicted polypeptide sequence is orthologous to G2382
taaaaggaagcaaatggtggaactagagaagatgagaatcgattgccacagagacttgaactgcataagaggcagattatggagatagcgcaggctgagatagcgaaaatatggcaggacgatgacgaggagaatgataactctgccaaaaatgctagcgggtaatatcggtatctatctgtaatattaatggattatgttaactgcaagctgttgtatcaattggggaagacgttatcccctttatatttcttttgaggaaataagttgttgattttgtatcaaaaaaaaaaaaaaaaaatcgtg

SEQ ID NO: 16581 - DNA, 802 bp, Malus x domestica
  Predicted polypeptide sequence is orthologous to G2404
ctccaccaccaacaacaacgaagccttacccacaagccttaccatcaagaaaaagacaaactttccctcgtcgtcgttcagaggcctgggctgcgccgcctccgcctcgcagcaagtctcggtgccggaggagattcggaactccgccgattggaagggaaagaaggtgaagaagaaaaaggagaagaagagcgccgccgccaagggcagcgctagcaacgagaagaatgaataccgggatgtcggtgatggcgggcccaccattggtataaattctgcaacttgtgtggattttcaggatgtttggtgcggccccggaattgggttctcgccggaaactgcgggctcggtggattgcgtggtggcgaggaggaatgtctccggcagaggcaagatttatggggataataataagatgagcagccacatgagcagccacagggagcgtccttgtttcgcaaggcgaaacgtgagccccgaaaccatctcgtttctggattctgaaccggattttgtctcgagccgccctgaatcagaggtatttggaagtaggtgttttcggcatgtccggcatccctcccctgaaggccttgccgagaatatgctgtttcaaagtaatcttatgatggggtgggaaaatgggaaagattccgtggactggaagactcgaagtttgaataacctggtcctaaggagccaccggccccgagttaggggcgaaagagaaaatgggccaacgctaaattcctgggaatttaaaaaaaaaaaaggaaaaaaaaaaaaccagcctgggcccacttcc

SEQ ID NO: 16582 - DNA, 635 bp, Malus x domestica
  Predicted polypeptide sequence is orthologous to G2404
tttggtgcggccccggaattgggttctcggcggaaactgccggctcggtggattgcgtggtggcgaggaggaatggctccggcagaggcaggattgctgcggacaataataagatgagcagccacagggagcgtccttgtttagcaaggcgaaacgtgagcccggaaaccctctcgtttctggattccgaaccggattttgtctcgagccgccgtgaaacggaggtgtttggaagtaggtgttttcggcatgtccggcatccatcccccgaagaccttgcagagattatgctgtttcaaagtagtcttatgatgggtggaagacttgatagatttcgtgactggagactcgatgtcgatagcatgtcgtatgagcaactgcttgagttgggtgagagaattggttacgtgagtactggattaaaagaagatgaaattaaccgctgccttcggaagattaagcttccaatgtcaagtgacgcgtcgccacattcatctgggaaaggagatagcaaatgcatcatttgtcaggaggagtacgaagcagatgacgagatgggcaagctgccctgcggacacaacttccacctacaatgtataaaacagtggcttgcccagaaaaatacttggcccatt

SEQ ID NO: 16583 - DNA, 391 bp, Malus x domestica
  Predicted polypeptide sequence is orthologous to G2430
gggtgggtctgacggcagccatggtagatttgccatggcagcaccaaatcaagggaggaaggaaggagatggatcagtgtgtttaaaggatggtggattgggcgactctggttggtggtggtgggaaaagatggtggatggacggctgggttgtgtttcgctgaggaagaaaacatgtgtttggatagcagaataacacatgtttggctagaagaaaaaatgctgattggttatatgttaaatggacatgtgtcattatttaattgttccacgtgttaaaatcagtatattgggtactctccattgagcccccccccactctccttttcaacatgcttttattgttaatttatgattattttatttgaaaaaaaaaaaaaaaaaaatgcgt

SEQ ID NO: 16584 - DNA, 597 bp, Malus x domestica
  Predicted polypeptide sequence is orthologous to G2455
tccaacaagttcggtcatgcatttgagtctctagagcttcatgaacaacctagagtctctcccatacccccaccagagaaaagacagcgggttccctcagcatataacaggtttattaaggaggagatccaaaggattaaagctagtaaccctgacattagtcatagggaagcttttagcaaggcagctaaaaattgggcacattttccccacattcactttggattaaagctggatgccaacaagcaaccaaagctagaccaggcttttgcaggaaagggaacttaaaagtctaatggcttgtactaaaacaaactggtatacaaaaaataccccctcccgtgagaagtacctgcaggcttctctccctctctatatatgtatgtagatatgtatgtatgtatgcatgatgcaattacttgaaaatattgaggttgatgaagtctcctgaccctgtagctaggaaacctctttagaacctcattttttgtttactacctataactacgtgtttaaattgattttccctaactgtctaagaagcaaatactactcctgtgattcgtccaggttgaacatattttaatcttttaagaa

SEQ ID NO: 16585 - DNA, 752 bp, Malus x domestica
  Predicted polypeptide sequence is orthologous to G2455
caagaaatactacctgatcaggctataaattacaaattaagctttgaaatattatgtcaatggatttgatggcatccgaacgcgtttgttatgttcactgcaacttctgcaacaccattttagcggtgagtgttccatgcaatagttcaatgaatatggtgacggtgagatgtgggcattgtgccaatctgctctctgttaatattggaggttcccttcagtcgaccaccattcctcctcatcaagatccccagaaacaacacctgagctctgaggattcaaataagaactgcggctcatcatcatcatcatcatcatcatcatccaaatccaacaagtttggtcatgcatttgagtctctagagcttcatgaccaacctagaatctctcccatacgcccaccagagaaaagacagcgggttccttcagcatataacaggtttatcaaggaggagatccaaaggattaaggctagtaatcctgacattagccatagggaagcttttagcacagcagctaaaaattgggcacattttccccacattcactttggattaaagctggatgccaacagggaaccaaagctagaccaggcttttgcaggagagggaactcaaaagtctaatggcttctactaaaacaaaaccggtatacacaatataccccctcctgtgagaagcacctgcaggcttctctctctctctctatatatatgtatatgtatgacgcaactactaaaaaatattgaggtt

SEQ ID NO: 16586 - DNA, 650 bp, Malus x domestica
  Predicted polypeptide sequence is orthologous to G2456
agaaagaaagaaagaatgtcttcagctgcagcatcatccactgtctttaactcacaggaccaacaacaccaccaccaccttctctcccccaccgatcagctctgttatgtccattgcaacttctgtgacaccgtccttgctgtgagcgttccttgcagcagtttgttcaagactgtgactgttcgatgtggccactgcagcaacctaatctccgtcaacatgtgtgcccttcttcttcctccggctaataataataaccaacttcaacttccctcacatccacttcggccttatgcctgatcagcccgtgaagaaaactaacatgcgccagcaggaaggagatgacatgctcgtgaaagatggatttttcagtactcctgccaatgtgggtgtctccccgtactaaaaggattagggtttatcctatttcgtccctctcaactttaactagtactagggaatcttatttatatcctaagatttcttgttattagtctctaaaaacttgggttgcatgcatggttatattactagctagtcgtcgattgaaggatatggaatctatatggtaatggtaaaaaacccatatgaatattgacggtttttaatgaaaatatatatcgcaagaaaaaaaaaaaaaaaaaatcggt

SEQ ID NO: 16587 - DNA, 568 bp, Malus x domestica
  Predicted polypeptide sequence is orthologous to G2457, G2459
ctgtatcaggcaacccaccatcccccaaagcaccctttgttgtcaaaccacctgagaagaaacacagacttccatctgcttacaatcggttcatgaaagatgagatcaagcgaatcaaagcagccaacccagaggttccacatcgtgaggcttttagtgctgcagccaaaaattgggctaggtacattcccagtcagtcgtctgcaggatcaggttctgggagctgcagcaacaacaacgaatgaacatgctagctacgtgctgccaaaaccctaaaacgccatgactacatgggtatcatggagatcttaaataaccatatccgcagctgcttcctacctacttcatccctcattagcagttcagcgtgcgtgcaattaattaagtactctcgtttagttcgtgttcagaactttgactctccttagttttcgtttcttttgttagtgaacttaatttccgtgctaagagtactttgattggtgtatggtaatttgtattgaatcaaaatgactgatcagtattctaattttgtattatttgatgcttttattaatttaacgttttg

SEQ ID NO: 16588 - DNA, 678 bp, Malus x domestica
  Predicted polypeptide sequence is orthologous to G2457, G2459
tcattgtgtcattaggaaatcaaagattgatgaagatgacaaattaaattaagcaaagcagcgtattacttaatttaaagtcacgtagcaaaagaaaccctaataagggggacttgacaagtacaatgaagaaggatattgaaatgtccttataaagaaacaacccagtagatcagtcaaggcaattcttgtatactaagaacaactttgatatgaccgagtgtctttgcctgaaattatcgtggccatcagttattcagtagtgcagcccttgacataagatgtttctcagggtcattgtccagcttagcctgattgttggcctccaacatcagcccaaaatgaatatgagggaagtgcgcccaatttttggcagcagtgctgaaagcctctctatggctaatatctggattattagccttgatcctctgaatctcctcctttatgaactggttatatgcagaaggtacacgttgcctcttctcgggaggtcggttcacacccctttcctcagtgacatgatctgaagttgggtctctggttgcattcttcttgttgcatttggaagaggagcccaaatcaatccggtaattctgagagttatagttgtagttttgtgcctgaacatcttgccaggacggtgactgaaaggcagcggccatgttcacggaccataaa

SEQ ID NO: 16589 - DNA, 686 bp, Malus x domestica
  Predicted polypeptide sequence is orthologous to G2465
cacgaggcagtgctggaagaattcataccaatgaagaaagattgtgataaaaacaagggaggaagtggcaataacaataagaaggaaaaggactctagggataagaagaattggatgagctctgttcagctttggaacactgataattatcaccaacatccctctagtgattccccatatgatagaaagcgagtttccgaaattgattctaagagaaatgaagcagaaaatggggtagcaaatgaggatcctttccagacatgtaggaataggactggaggaagagcatttatgccatttaaggggtaccctgctttttctgtgacgccgttgaggctggaagagaaagaggaattgccagttcatgggctgtctctgctcactccagggattaagaatccgaaggaggaatcgacttccagtggttcaagatccacctgtggcaggtcagtctccttctctactgccaatactcaatccaatacgcgtactccgccgcagcagccaactagccggaagcagagaaggtgctggtcgccggagttgcatcgcaaatttgtcaatgccttgcagcaacttggaggttcacaaggttagatattgaaacttttgttttcttcaacagttagatatggaatctgaaaatgcaggtcctaatgtacattaagatgtgtgccttacttttg

SEQ ID NO: 16590 - DNA, 601 bp, Malus x domestica
  Predicted polypeptide sequence is orthologous to G2505
cgcattttttttttttttttttcaatcaagtgcttttgtattaaaataattaattgaaaattcacaataaattcattaagaaccagaaaaacgtccaatattttaatttctctctaaaaggaacaactataaattccttccatggctgtcgaatttggtatatttgccttaatatataaaatatgcatggttagagccattttggtttggtaattagctctaatccatattattttgcatagccccaaaaatccatctctccacgcaacgagaggtgctgggggttaatttggttgacagaagagggtgcatttgcatcctcatacctggctgctcctttggacgacgaatcttgatcatttccaaggtcatgagaagtaaccaggcggtcgagcatagcccattcactcatcccctggtgatcatgattattatctcttccgccagctgctccagctcctcctgcaaccgtattcagttgatggtttggttcgcacgtgccaacctctaacactggctcacaagcttggtaccggaggccctcactgactttcgcggtctctagggtttgtcatgagctgcttgaccatgccgtggctag

SEQ ID NO: 16591 - DNA, 690 bp, Malus x domestica
  Predicted polypeptide sequence is orthologous to G2510
agagggttctaatattgtacatggaacaaccaccatacactgaagatgaccagagcaccaccaccatcaacacccaaaaagccgactcgcaaggtggaggcacccgccacccggtgtaccgaggcgtccggaagcggaggtgggggaaatgggtgtccgaaattagggaaccgcgcatgaagtcacgcatttggctaggttctttccccgtgcccgagatggcagccaaggcctacgacgtcgccgcctactgtctcaaaggccgaaaagcacagctgaacttccccgaggacgtcgaccacttgcccaggcccgccacgagtacggctagggacattcaggcagcagcagcccaagcagcacatagagtcatcaagtcatcacacatcaccaagaaaaatgacgacgacgacgatcatcacggtggattggacggtggcgatgatttttggggagagattgagttgcctgagttgatgaacaaaagcgggtgctattggaattcatgtggctggaatatgactgcgttttcaggtgatgcagcggcggtagcatgtccggagggagaggcttgcctctgattaagaagtgttgggtgtggttggtacggccatttatgtgtacttatgtgcttgtttagatcatcaggttttcaattaaaccccacttaaaatcgagcacaactatccc

SEQ ID NO: 16592 - DNA, 566 bp, Malus x domestica
  Predicted polypeptide sequence is orthologous to G2520
ttgtaacaaggttattggaaaagcacttgtgcttgatgagataattaattacatccaatcgctacagcggcaggttgagttcctgtcgatgaagcttgaagcagttaatacaagaatgaaccctggaattgaggcgtttccttctaaagatttcggtcaacaaacattcgataatgctgcaatggctttcagtacacagcctcccagggaatataaccgcggcaattcacccgagtggttgcatatgcaggttggtggtggtttcaatagaacaacatagcctagaaaactcgtcttcagatttggaataaaggcaaagggaacgcttcctccttcagtagctgtttaaaaaagtataccgcgttattaaatcaacgaagacactctcacatcctacatcaggcatggagctgtgattatttccgtcaacgatgctgctgcttaagttagtaatgtaactaaacatctccatctgtttctgtgttgaaaaaccgaacttttaacttcgtatatcatcacgcctctatagcaggctacatattcttctccgtaaaaaaaaaaaaaaa

SEQ ID NO: 16593 - DNA, 758 bp, Malus x domestica
  Predicted polypeptide sequence is orthologous to G2522
aaaaactgggtttgtgcttaaacactggcattgactcaaagttgtggcctttttaaaatataagtttctgaagagtggtttttggaattattggagtttgaaagattagagcttaggattggatgcatatggttatggggttgcctttgaagatgcttggtgtctaaggctttataatgagttggtgacagtggacctgtttccttccagtctctcttgctctttcccttaagcatgaagcctttttgttgtttcccttggtttggagggggcattttgcattgagttgcaaagttggggcttcaaaattgcctttgaaagataaccgaaataaatgcatggatcgtagggaccctatggcattgtcggggtcagcctcttactttacatctagaggaataactgggtccggaacactgtctggattacatggatcgccaggcattcatcccttatctaatccaaatatagcatttcaatctaatattggaggaactaacattgggtcaacattgccggtagagccttcttcagctatttcataccatggtgtcaatgtgggtgcaccaactgtggcaccaccacgccaatctttgaaaaggaaaagaggaaagccccgaaaatatggacctgatgggaatgtttcattggcattgtctccctgcagcatctgctattcctggtaaggtaaaatcaaaccccaaaaaaaaggaaaaagggcggcccaccccggggcctgggaaaaaaaccaaaaaata

SEQ ID NO: 16594 - DNA, 340 bp, Malus x domestica
  Predicted polypeptide sequence is orthologous to G2525
caaattcaaacccacctctctctctcactctcactctcactctctctctctctctccctccacaacatttccacttccatggaagaaacactaccaatgttaaccactcgccggactgaccaaagccccgtcaaccaccgagaccacctccccaaaagcccaagagttccaatggagtttctctcaaggtcatggagtgcctccgctcttgaagtctccaaagctctgtctcagtctcaccctcctccgctgcctcctcctcctccttcatgcatggctaattccaagtcctcaaacagctctttctcttgcaccaccaccggaaccaccaccactcctt

SEQ ID NO: 16595 - DNA, 535 bp, Malus x domestica
  Predicted polypeptide sequence is orthologous to G2536
tcgagcggccgcccgggcaggtacttctactttgaagacaacaatggtggacaaagcaagctcatcagacgaaacttattcacattccggagagcttggtgatctcccggagacgtcagcagggattaatagtagtaattgggagattaatgaaggttttgaagaacctttatgggaatgggaacaactaaatttcctctaagaagcagcccacagtcaaattttaaacatgcagcagttggattaggcatcaagctaagctattagaggaagcaaggcatagtatatcttaatttagatgcagtgaaatgtaagctttcttttactactccattgtcaagtataagagagagaggagagtgaaaaattagaagaaagtaaaccattcaaattcatgtaaaataaagttaaatttgaggcgatgtaaaatggataatacaagcagagtgttggagttaattttttaaggccgatatttgactttcgagaagatcaaaaaaaaaaaaaaaaaaaagtacctcggccgcgaccacgc

SEQ ID NO: 16596 - DNA, 664 bp, Malus x domestica
  Predicted polypeptide sequence is orthologous to G2550
ttcagatttttttttgtgctgatctttttgccatgcacagtgtagctggcagagattgagtctaacatgtcaagtgaacactggaaggagcctctttatgcaagtatttattctttgggttttgtagcatttgctgggatctagtttcaacttaagaaactggttggcacgatttcacctctgcgaaatccatttagatgtcatgtagatttagctttaattgtataaacctgcagggtcatctgaattgttatcataaatggatgcaataagtttcttcttcccatatgattgatgcagatattggcttatttgacctttaagattgaacaaatatttggaggagtgattacaacacattgggctgttcttggccatatgcacttattgggaatttagtttacgggagttcatattacaggtttaggttattaagttacattaaagtttcattaactctcataatgtttaacattacgattattggttcattaagtgaaaaattattgggacaacagcttgatctaccatcaatatgcttatttctcttatatcatataactgattcttattgggaattattgtagggttagtttgtattggactgttggtgacaccaacacggaatcctttgtgttggtgttcccttagcatcactctggta

SEQ ID NO: 16597 - DNA, 591 bp, Malus x domestica
  Predicted polypeptide sequence is orthologous to G2571
cgactggtctagactgaacgctgtgaaaaactccgtggatgcgaaaatccaagctatttgtcagaaggtgaagagagaaagagcaaagaagaacgtgaagaagagcagctcttcagttggtggtgatgggagtttccctgagaacgggaaggttgtgaagatggtatcctcgccgtcgccctcatcgtcgcctttggtcgatggcgaaggttttggtcacgaaatggtgtcattaacgcccacgccctccgtgtctgaggacggggtttggaggattgagaacccgccgccgtctgtgtcaacagagtttcaaatggggatggcggagttgggtatgggagagaagtcggaatttgaggggtgttcacttgccaaaatgccttcatttgatccagagttgatttgggaagttcttgctatttagaaagaggattttgatttgggaaatctggtttttagattaattttcccttaattttatcaacggatttttgtcacaacccgtgtcttatgttttatcgagtcatcagtttggtccttcatgtttaaagcctcatcagttcattcctctatcaataaaattcgctcatc

SEQ ID NO: 16598 - DNA, 604 bp, Malus x domestica
  Predicted polypeptide sequence is orthologous to G2592, G2713
atcgttaagaagcctgagatctgcgggaagcttacttttcctgtgtcgctgaagcagccaggttcacgggatggactcgttcaatgcttcattaaaagggataaatccaatttaacatatcatctatttctgtgtcttagccctgctttgctagttgagaatgggaaattccttctttctgcaaagaggactcgaagaactacttgtacagaatatgttatctctatggatgctgacaacatctctagatcaagcagcagttacattggaaagttaaggtcaaactttcttggcacaaaattcattgtatacgatacgcagcctgcatacacttctgaacatgttcccccaccagggcggtcaagccgtagatttaattccaaaaaagtctcaccaaaagtcccgactggcagctataacattgctcagataacatatgagctaaatgtgctgggcactcgcggtcctagaaggatgcattgcatcatgcattctatcccggtctcatctcttgatgcaggaggtactgtccctggccaaccagaactccttacccgagccctggaagactcattccgaagtatctctttctcaaagtctcttg

SEQ ID NO: 16599 - DNA, 601 bp, Malus x domestica
  misc_feature (433)..(433): n is a, c, g, or t
  misc_feature (567)..(567): n is a, c, g, or t
  Predicted polypeptide sequence is orthologous to G2592, G2713
aacagtgtatcagtggctgaagataagaacttgggatgattgatggagtgtggatgtaacattttttggtgaattttactgattgatatatcattggaggtattggagagaagatattttgtattgaattgttaatgattggccgctttggctgaaagtataggactttggcagtttaggcttctgggttttgtttcttaggcttgagtaatttgtatttcggggcgaagtttgtgttttttgtgatgagtgtgggataacctggagaggttggaggatttgtagaaagttttgcggttttgagttttgctaaggcaaggataaagacgcagcgatgtcttttaagagtatgattcaagatatgaagggtgagttggggagcatttcgaggaaaagctttgatgttaaatttggaatgagatcgaagtctcancgggtggttctggatacctccttccggattgatgctttgaaacagaattgttgggcaaacatgccgccagaacttttgagggaagtgttgaatgaaataaaagcgtctgatgaaacatgggcctccgaggaaantgtggtctgctgtgctggtgtttgcaggaattgg

SEQ ID NO: 16600 - DNA, 761 bp, Malus x domestica
  Predicted polypeptide sequence is orthologous to G2592, G2713
cgttgctgtcggaaatgtgcaaggaaatcgtcagaagtcctgaattttgtgggaagattaccttcccagtcgccttgaagcagccaggatctcgggatggaaccatccagtgctttatcaagagggacaagtctaatttaacttaccaccttttcctttgccttagccctgctttgcttgttgaaaatgggaaatttcttctttctgcaaagcgaacgcggagaactacttgcacagagtatgtgatctccacggatgctgataatatttcaagatcaagcaacaagtacattgggaaattgaggtctaattttctaggcaccaaatttattatttatgatacccaacctccctacaacagtgctcagctttccccacctgggagaagccgtcggttctactctaaaaaggtatctcccaagctccccactggcagctacaacatcgcacaggtgtcgtatgagttaaatgtgcttggcacacgggggccacgaaggatgcactgcaccatgcactcaatccctgcagcatcccttgagcctggtggcattgtccctggccagcctgagattctccaacgctcccttgaggactcattccgaagcatttccttctcaaaatcaattgttgattcaagtgagtttagcagtgcacgattctctgaaatagttggggcccattgcgaagaaaaatggaagggaaagacattaattcttcggaacagggcaccagtggcatgaacagtgcagtgttggtgctta

SEQ ID NO: 16601 - DNA, 555 bp, Malus x domestica
  Predicted polypeptide sequence is orthologous to G2592, G2713
cagtacacgattttctgaaattgatgtaccccgagatgatgaggatggcaagacaagacccttggttttgaaaaacaagcccccacgatggcatgaacaattacagtgttggtgcctgaacttccgaggcagggtaactgttgcttctgttaagaactttcagttgattgctgctactcagcctgctgctggtgcacctactccgtcacagccagcaccgccagagctcgacaagatactcttgcagtttggcaaggctggtaaagatatgttcacgatggattatcgctatcccttatctgcatttcaggctttcgctatctgcttgagcagctttgacacgaaattggcttgttaatagaagagagtaagtggacggtggtaagcagaaaacaccgtcgacaatcacgctctttctcgcctttatcttcacttttttcctgctcttgtttgcgtttgcgttacttagggtaggaaattgtctgttttgttctacaactcaattgctaccctaataacaaaaggtttaacagcaaaaaaaaaaaaaaaaaatgc

SEQ ID NO: 16602 - DNA, 824 bp, Malus x domestica
  Predicted polypeptide sequence is orthologous to G2592, G2713
tttgatgggcagccgagtcattcgggagccaagattgcaaaaagtcgctccactaggcttgtcaatttgaaacaagtttcccctagagtccctgctggcaactatccggtggctcaaatccaatatgaactaaatatgttgggttccaggggtccgaggagaatgcagtgtaccatggattcaattccatcctcttcaattgagcctggaggagtagcacccacacaggcagagttttcacatagcaatgcagaattatttccatccctctcatttaatcgatcgaaatcaaaccgcatggagagtttcctgtcagggcctttggccagacagaaagatggggtgctggtgttaagaaacaagtctcctcggtggcatgagcaactccagtgttggtgtttgaactttcatggacgagtaacagttgcttcagtgaagaactttcagttggtggcttctccggaaaatggaccccctgggccacaacacgagaagatcatcctccaatttggaaaagtgggcaaggatcaatttaccaatggattaccggtatcaaatatcagcgttcccagcattttccatctgccctcaccagctttgacacacggattgcttgtaaattatagccaggtttaaaagttcacctatatgggttgagttcaatgaagccctttctcctgaacggaatccctatggctggggaatggccagggtattagacatcgctcccaccccccccaaactacttctggttatcatttaattttacccaaaattctaggagattttaagatacaattaacaaggacgggaaaaactactca

SEQ ID NO: 16603 - DNA, 798 bp, Malus x domestica
  Predicted polypeptide sequence is orthologous to G2592, G2713
cgttatatctttggtttcagatgatttttctcgagccagcagtgcatatgttggtaaattgaggtccaactttttgggtaccaagttcaccgtatacgacagccagcctccatgtgatgcggtacccaaaccaaaaaatcgatcatctcgaaggttccattctaagcaggtatctccaagagtaccagcgtgtaactacagcgttggcaacatctcttacgagctcaatattttttgcacaagaggtccaaggagaatgcattgtgctatgcactccattcctgtctcgtccattcaggaggggggcaccgccccaacaccaacatcgttgctacaagcctatgacgaacaatttgctgtctcaccaagttcaaaagaaaaggatctggtcgcagagttcagctctacaaccctctcggagccaaacgtgtcagccccgggtgcagagccattggttttgaaaaacaagtctcctaggtggcatgagcagctacaatgctggtgccttaactttagaggacgcgttacagtggcttctgtgaaaaacttccagcttgtggcagctgttgatccgtcccacaacgtttcggctgaagagcaagagagggtaatcctacagtttggaaagattggaaaagacatcttccccttggattatggctaccccgctgtcctgtttccaagcgtttgccatctgcttaaaccaccttcaacacaaaccccgcgtggtgaagaaaaaactttggttgtaaaaaaaatgaactcttctttttgctgaaattttggtttctggtaaat

SEQ ID NO: 16604 - DNA, 629 bp, Malus x domestica
  Predicted polypeptide sequence is orthologous to G2604
gcagcttgtgtgctctggatgccggaaccttttactctatcctgttggagccacctctgtatgctgtgctgtttgcaatgccgtgactgctgtgccgcctcctggcacagaaatggcacagctagtctgcggaggatgccacaccctactcatgtatatccgtggagcaacgagtgttcaatgttcttgctgtcacacggtcaatctagccttggaagcaaatcaggttgcacatgtgaattgtgggaactgcaggatgctgttaatgtatcaatatggagcaagatctgtcaaatgtgcggtatgcaattttgtgacatccgttggggtcccggcaaacacccccgaacagaaattcaacaactaaaagttatcatacactactactgcaagatgctacgtacaactttgggtttgcatcttaaattacaagagttttcctccaatatttcgtctctcttagtgagaagagaaaactttcttgctccttcacatgtatagagttacgtctttttccttgcgtgaataagtagttatgtcaagatttggatctatgagaagtttctacaacaagactatgaaaatttgagtgcattattgaaaatctttggataaagatataaaaaaaa

SEQ ID NO: 16605 - DNA, 677 bp, Malus x domestica
  misc_feature (7)..(7): n is a, c, g, or t
  Predicted polypeptide sequence is orthologous to G2628
tgcaggnaaactaacgaagatttcgagtgggaggaagttgaagacggggttgatgagagagaggtcttcagtacgtttattgatcacgacatcgaggaatcaggaccggtggcagtttcagtttcggcaatgatggcgccggaagaggaagtgagtgtggagagatatgagcatgtggatagtttggaatgggaaattttgttgaatgccaatacttgggagataaatccagatgtggcgccttatccggacgatgattatattcacactgcagaatatgatttgctgtttggtcaattctctgagaatgagaatgcaacagcgggcaggcctccggctgccaacgctgtggttgaaagtctcccatccgtagttttaactcaggaggatgtggaaaagggcaatgcactctgtgccgtttgcaaggatgagatgaaatcgggggaacaagcaaagcagctaccttgcacgcatcggtaccatggtgactgcattgtgccgtggctgcgcataaggaacacatgtcctgtttgtcgacatgaattgcccaccgctgacgctgcttacgagcgtagaaggagccaaaggcatgctcgtgggtcgaacaatggtcgggcaatcttttgagatcttccttcggcattaggtactcgaaattgtagatactgctgttggta

SEQ ID NO: 16606 - DNA, 684 bp, Malus x domestica
  Predicted polypeptide sequence is orthologous to G2633
atttcaagcttcaaattccttcaaacaagtcatttcctttttgggaatgttttgagctctgagttgtgttttcatggaggattctctgttacttgaaatgggttggtgatgttgctttaagataatgcttctggcaagcgaattcgaaggttcctttatagctctgacgaagtttggataacacaaatagaaagacactttttggcaacagagtcaacaaggagactactcttcaatgcaagcatcgaagcagcagagaagttcagggatgtcaaaccggttgcattatcagccaatccaagaagtagaagcctactgcttgcctcggttccaaactttggacccccagctacattacaacgagagcagccaaagtacccacctcccaatgcagagtttccactactgcactttggagtcttcctggtctaatggtagctacaccatttataactccccatcaaatgtcagcttctcacctagtggaagcccgatgtcacagcaagactctcattcatatccgtctgagcggtatcattcccctgaccagacctacagctctccgataagcggatcctgcataactgatgatgcacctgacttcaagtacaagctgaaacaattagaaactgtaatgctgggtcctgattccaacattcttgataactattgcattaatttccc

SEQ ID NO: 16607 - DNA, 657 bp, Malus x domestica
  Predicted polypeptide sequence is orthologous to G2717
cacgaggaaacacttgaacaccaatagtccataaaaattaatccgaaacatttcatataaatttcgtaaaattctcagattcttcaaatttcggattatccaatcgatctctcagctgcccacattttcgtcagcttctcagtgatttctccgatccggaattgccgacatgcattgccatttgattcaattgatgtgaattttcttagttggatttcgttctgggagggttctggatttcggttaatgggtgctcctaagcagaagtggaccgccgaagaagaagcagcccttaaagctggagtacttaaacacggggcaggaaaatggcgcacaatactgacagatcaagaattcaatactatcttacatctgcgttcaaatgttgatctcaaggacaagtggagaaatataaatgtgaccgcaatatggggttctagacagaaggctaagcttgcacttaaaaggaacttaccaactcctaaacacgagaacaaccctttggccgtgagcactgtaatccaaagtcatgaagaagttgttgacgctaagcctcttgccatttctggtggaaagtcgcagactattgaatcaaaagattcaaaacaaccaattgccaggttggatcaccttatattagaggctattacaaatttg

SEQ ID NO: 16608 - DNA, 608 bp, Malus x domestica
  Predicted polypeptide sequence is orthologous to G2763
catcgactctgatttcgaatcccatagccacctccgatcgagctcgggattcttctagaaggaaaaagaagaagaaaatccagcccaagcaggaccacctccaccaccaagaacccgcccacagccacgccaagtggaagtccgaggcccagcagcacctctactcctccaagctcctccacgccctcacccaagtctccattaactcggcacccgactcctccaccgccgccgccaactcctccgcttcctcttccaccccacgacgcggccgagccgttcgcgaggccgccgacagagttctcgccgtcgcagctaagggtaagacccgctggagccgtgccattctcaccagccgccttaaaatcaagttccgtcagcataaacggcagagatccgccgcggcgtcggggagcgggtcgacccggcccaagaaacccaagttcagtgtccaccggctgaaagggaagggcttgccggccgtgcagaagaaagtacgggttctggggcggttggttcccggttgccggaaacagccgttgccggtgattctagatgaagcgactgattacatcgcggctctggagatgcagggccgaaccatggaa

SEQ ID NO: 16609 - DNA, 611 bp, Malus x domestica
  Predicted polypeptide sequence is orthologous to G2783
gctctccctctcacaggaccttttcgtcctctcgattagggtttctctctctctctctctcctcccattctctctctacattcacatgatgatgcaaccgggtgcaggcggtgtggctccgtcggcattgggccagcagcccgcccagcagtatggtcagcaacccgcgcagccctacatgatgatgccaccgccgactgcccaggcacctgccatgtgggccccgcagtcgcatgtggcgcctccggctcctcagctcccccagcccgcctccgccgacgaggtccgcacgctttggatcggcgacctgcagtactggatggaggagaactatctctacaatatttttcttcacaccggcgaggttgtttctgtgaaagtcatccgcaataagcaaacttgtcaatcagagggttacgggttcattgaattcaatagccgtgctgctgcggaaagagtgcttcaggcattcaatggtactccaatgccaaatggtgcccagaattttagattgaactgggcatctaccggtgagaaacgttctgatgataccccggattatacgatatttgttggagatttggctgctgatgtgacggattatgtgctac

SEQ ID NO: 16610 - DNA, 659 bp, Malus x domestica
  Predicted polypeptide sequence is orthologous to G2784
actgtttttctgggtctttatttctccattggtggtgtatgaaacatatagcattgaagggagcagcgacattgaaagaaagaacaggatgctgcaacaaaagactaaatggaactgcacctgtgatgcctgccgaggataaccctgaggaggttgatttcgactttgagaagtatagatcaatgcttgcaacaggtgcccagctcaccactgaaacaccagacgggaagtacacggttagatgggtgtctgtcatcatcaacaatgaagccaaggttcttgttcaaatgaggaagctcggtctgttgaaaagaaagaaggaatgtatcatactggacatgcatgcggagctgtataaagattcagaagccggtgagaatggtacaggttatctcatcgtgttaacgacgagtaaggggacaatcaagctggacatggaagccgactatcagcggtacaagacatgggcgacgaccattaaccatatgctcttggtctctacttcgtttacgaaatatcatcttcaatactacaagaactagtgttcgatgatcaattacaaatatcatccatcagaaagatcattgtgttgctgcacctatgtgcatatttgccctgtacttttgtaactataaatcaattcaccaaaaaaaaaaaaa

SEQ ID NO: 16611 - DNA, 669 bp, Malus x domestica
  misc_feature (481)..(481): n is a, c, g, or t
  Predicted polypeptide sequence is orthologous to G2791
cttcaatgctggatgagataatcgattatgtaaaattcctccagctccaagtcaaggttctgagcatgagcaggttgggcggtgcagctgctgttgctccccttgttgctgatatgtcctctgagggtggcggtgactgtatccaagccagtgccaacggcgggacccgcggacggagctcaaacggcaaccaaacggcgtcatcatccaacgacaacagcatgacggtgacggaacaccaagtcgccaagctcatggaggaagacatgggctccgccatgcagtacctccagggaaaaggcctctgcctcatgccgatttccttggccaccgccatctccacagccacatgtcactccaggaaccccctcctccagaacagtaacaacaacccggtcatcccgtccaacggtggcgacgggccatcttcacccagcatgtccgtgctgaccgtccagtcagccaccatgggtaacggcgngggttgagggttccgtcaaagacgccacctccgtttccaagccctgactgagggcgccgccgtcgatcgtcgactgaccttttggctttggtctttacttttttagtgacaaatgaacacacacagtgacgtgggctacgaggcggtctaaagtctacgaaaataaggcaatctggggtggtgctttt

SEQ ID NO: 16612 - DNA, 771 bp, Malus x domestica
  Predicted polypeptide sequence is orthologous to G2802
gagggtacgccttgtccgccttccccaatgggactagcgaggccaatggttccgatgccccagctgcaaccgctaatattaacgtggcaaattcccttcttccagcgtcttccaccctggacatggcatccttcaagtctttaaactgccaaattccacggttgaactccggccacggagccatagggatgtacgccggcacaggagccgggccgaaatgcccggttggaacttcctaatcaagcttaattaggagggtcaacatgttttaagtataaccaaacaaaagccacccccgacaatctgtagataatcaaatgatatcaaatctctccaccagcaccaccagcaccaccaccaccatcaccgccagcagcagcagtaccaccatccaaatacccaacaatactacttactagttactaccatacaaaaatgcatacgtaaaaagggcagtgtaaggaaggaagtgggtccccgtcccatccccattaaccttttccttcttttatttgttgtttgtactattttcggtcacatctactccccccattttctgcactagctttatcaagtcggaagaaatcaaagcaccacaggttaaaagaaaaggagacacggtaaaaaaaaaaaatgttagtttgttgtaacttttggcactgtaattttaattttcacccttccaagtgaaacaattgcctaaaggtttagtgctagacgagtgttactgttagtctctgttatttcaagtgtaatcaaaatctttgtaca

SEQ ID NO: 16613 - DNA, 736 bp, Malus x domestica
  misc_feature (558)..(558): n is a, c, g, or t
  misc_feature (711)..(711): n is a, c, g, or t
  Predicted polypeptide sequence is orthologous to G2834
aagaatgacgttgaacaatctcacattcctggaacaaaagatccatcagcttcaggatttagtgcatgtgattgttggccggagaggtcaagttctaggacgaccagatgaacttgtggctcagcaacagcagctcataactgccgatcttacttcattaattgctcagttgatctcgacagcaggtagtcttctaccatctgtgaagcatacgctttccaccacgttaccttctacaggacagtttgggcagcttggtgggtcatttattccttctgcagcaggaaatgatgcgggtgttaagatgcaaattaatagcggaagcaaattagctgatcaggccaaccagactgatctaataagtaattatgggactgagcatattgaagaacatgaaaccaaagatgaggaggatgctgatgaaggtgagaaccttccgcctggtagctacgaaattttacagttagagaaagaagaaatccttgcacctcacactcccttctgtgcaatttgcggaaagggattcaagcgggatgcaaatttaaggatgcacatganaggtcatggagacgattacaaaactgcagcagcacttgcaaaacccaacaaagaatccagctctgaaccaaccctttatcaaaggtattcatgcccttatgccggctggcagcggaacaggatcacaaaaagttcaccctttgaaaaatattnggtgtgtcagaatcactacaaaaaa

SEQ ID NO: 16614 - DNA, 679 bp, Malus x domestica
  Predicted polypeptide sequence is orthologous to G2834
cacgaggcaaagatgaggaggatgctgatgaaggtgagaaccttccgcctggtagctacgaaattttacagttagagaaagaagaaatccttgcacctcacactcacttctgtgcaatttgcggaaagggattcaagcgggatgcaaatttaaggatgcacatgagaggtcatggagacgagtacaaaactgcagcagcacttgcaaaacccaacaaagaatccagctctgaaccaacccttatcaaaaggtattcatgcccttatgccggctgcaagcggaacaaggatcacaaaaagtttcagcctttgaagactattttgtgtgtcaagaatcactacaagagaacccactgtgacaaaagttacacttgcagcagatgcaataccaagaagttctctgttattgcggatctgaaaactcatgagaagcattgtggtatagacaagtggctttgttcttgtggcaccaccttctcaaggaaagacaagctttttgggcacattaccctttttcaaggccacactcctgccatacccctcgatgaaacaaaaggaactctagggccagcagaccacggggaaggcagtgaagcgtcaaacagagttggaagcataagcttcagtgttagctccactgctcccggcggaggtggtgcagctcaaagtctcatggacgt

SEQ ID NO: 16615 - DNA, 484 bp, Malus x domestica
  Predicted polypeptide sequence is orthologous to G2846
ttttttttttacaataaagatcgctttaatttttatttttctcttctctgaaataatgaaaaggtgttggtgccaaccctcaacgtacatgaacaggaacaaaaggcagctcttcacaccccatttgctaaattcagctcttgtcaacaacttaatatcgctaaaccctaatatattgtcaacttccgctaaatttagcacctgttcctgttccaaacccacctaataatattagggttttacataattataaaaaaatggtcactagctaataattaatcgctccctcagctagcagttggcccagcatgcaccatatatatttaggccttggctccatcagctcttctctgccgatcacctgaaggttgctccgaatgttggtgtccaaaaatcagcggtggtctcattagcaaccgggaatgtgcttgaaatttggaaccaaacacagccctcggctttgtaaatcttgttttgcctcctt

SEQ ID NO: 16616 - DNA, 551 bp, Malus x domestica
  misc_feature (10)..(10): n is a, c, g, or t
  Predicted polypeptide sequence is orthologous to G2851
gaactcccanaacagcattaacttattgggcagtagtcctcatggagatgaagaatttcagctgcagacacttagcagctgcaggcctgtttggtccccagttcaaaccatgccagtttcatcccctagctcttgtgtcactagtttaagtaatactaataatatattggacttctcctataacaaaactgacaataagaggaaccaacatgcagatcactcatctgagtgtaatagcactgacactggtgggataagcaagaaggccagggttcaacaatctccaagccaaccacctctcaaggtgaggaaggagaagctgggtggtaggataacatcccttcaccaactagtttccccgtttgggaagactgacactgcttcagtcttgttagaagccatcgggtatatcagattccttcagggtcaaattgaggccctcagctccccttacttgggcaatgcctcaaaaaacacgaggaagcaacagtctctgctgaatgacaattgcctgaaaagcaaaggcgctcctaaccaggaatcacaagatc

SEQ ID NO: 16617 - DNA, 585 bp, Malus x domestica
  Predicted polypeptide sequence is orthologous to G2851
cccccttttttttttttttttttttttttttttttttttaccccccaatatgttgttctattcaatgtggttacgtctcaacccatcgtacttttcaatggggcatattaatctcttgtatttctagtgcccgcaagtaaaagcattacactgcatacaaaaggtttccaggttcaccaaaattttgaaaccgaaatttcacccaaccgaagaaactaaaagaaaaaggaaaaatattgaaaaatgaaaccttccaagtaatcgacgttacccgtcgttttcgttttgatgcgcggagtgcagtccaaatgtgggcccaccatcgggccgtaagccgtaaatgtaattcctgacttcctgcgctatcatccgctgcatgatcgtcagcaaacacgtctcatccatctccaccgcacatttctccccatcgtcgttattgtccaccgcttcgcgatcgtgttcttcctcctcacttttcacagcgacatcgttctccgcattctcaccaggcggcgatagcgtcagcgacgtcttgactatcactccctcccctcccgcgtccgccttaaaaatctcatgctccgg

SEQ ID NO: 16618 - DNA, 825 bp, Malus x domestica
  Predicted polypeptide sequence is orthologous to G2851
tttgcacccagcaacaacaacacttccccttcttcaacaacttcttcttcaggacttgccattccttcttggcatattgagaataacaaccaggagcttccagagtcttggagccacctcctcttgggtggaattgtaggtgaagatgagaaaggggcaatcatgagacaatttcatcaagctgctaagaaattggaaaattgggatgagcaaatattaaatagcactcaagctccaaatgctcctgttgtggacgtgaagcaagaaaactcaggaaatagcaacggctttgtgtacggacatcatcacgggaatgatcacatccgaggttttaatccatcagctgcagctttgtcttctttgtctcagattatgcaatcaactgctgcctctgcagcctcatctcctaagtcatcgtgtgtgacgagtttcagcaacaacaatattttggatttttctagcaagtcggacgtgaggcatccaccaccacatcggtcctctgatcagtgtaacagcactggaaatggtggggcacttaagagagcaagggttcaaccttcttcaaccccaactaccttcaaggtgaggaaggagaaattaggtgacagaattacagcccttcatcagctagtttccccatttgggaagactgacacagcctctgttttgttagaagctattgggtacatcagattccttcagagtcaaattgaggccctcagttcaccttacttgggcagtggatcaggaagcatgaggcagcacccacgtctgctgttcatgggagaggaattgatgttccctgaaaatctggtagctgctcag

SEQ ID NO: 16619 - DNA, 726 bp, Malus x domestica
  Predicted polypeptide sequence is orthologous to G2854
cgatgagatccgctccctctggatcggtgacttgctgcagtggatggacgaggcttatatcctcagctgctttggtcccaccggagaggctgtgaacgcaaaggttatccgcaacaagcttacgggtctgccagaaggttatggttttatcgagtttaggtctcgtgctggggctgagcagatcttgcagacatacaatggcactcttatgcctaacacggagcagaatttcagactgaattgggcaaccctaggtgctggcgagagacgacaggatgatggtccagattttaccgtctttgttggggatttggctgctgatgtgactgattatatgcttcaagaaacatttagacaaaattaccattctgtcaagggtgcaaaggttgtaactgataggaccacagctcgatccaaaggatatggttttgttaggtttgctgatgaaggtgagcaattgcgagccatgactgagatgaatggccagttttgctctaccagaccgatgaggattgggcctgcggctactaagaaaccagccagtggtggacagcaatatcagaaagcttcctacccaagtactcaaggaaatccaggcgaagctgatccaaataatacaacaatatttgttgggggtctggatcccagtgtgaatgatgacatgttgaggcaaagtttttagtcagtttggtgagcttggtcatgtgaagatccagtaggcaagcg

SEQ ID NO: 16620 - DNA, 410 bp, Malus x domestica
  Predicted polypeptide sequence is orthologous to G2869
cagcagtagtactttctttcattatctaaaataataggagtataatgataactctcactattttctttctctccagcccaactcactggtaatttcttctacatctctcttcgttccttttctcttctctctctctctttgacattgaattgtgtgtttacaatgaacgaatgaacctccttttacagaggttttcattcgacagagtaatgcagcaacactattcactttacaaaatttcttcaaataaatagtaatccatcatatttttcttcatataaatcgtaaagaactattcatgtgggcgatccgcatattacattacaacatttagtaactatttttaaatgaagaattattaaaaaaaaattgaagtgccaatttagtctctaaactattacctagtaaaa

SEQ ID NO: 16621 - DNA, 562 bp, Malus x domestica
  Predicted polypeptide sequence is orthologous to G2907
tttttttttttcattgaacttcaactttcttagatagaatattttcttttccctaaaaatttaaaacagcattaagacattcatacctactcgggaacaactaatgcccctatagattttacaagaggatacgtacggtgaaccggatattgatcactctggagctgctgtaggcatgcaaacatcgtcttcatccaacaatgctgcaatatctacgaggtcgtcatccatatcagctctcccatctgaactattcatactactgtcgtataccaccttgcgtttcctgtatctcagtgacaacattaagcagccgactgtattgatctcttgcctcgggatattgaatcatggacttcaccctagcaagcgccttttgcaacctttgctctgtttgcttccttccttctttcagtacatcgtaatcatcatccttcgaggatgaagcttgcatgctggggggctcagcaagtgcttctggcttgaacccacgcaatccacttccttttcgtctccaacgcaaaattatcttctccacaattcctacggaccagactatctt

SEQ ID NO: 16622 - DNA, 625 bp, Malus x domestica
  Predicted polypeptide sequence is orthologous to G2913
aaatttgtaccaatttggtttcgattggaatttctgagctcatctaatccaacgtttccaggtgagaaagttgcttaaatttcgatttttattaaactcaggtgagcttcttcagttttttagattgatttgaaggaatttcttgcccagaaaagctagggtttcctggtaagtttttcaagtctttcatcttgggggttttgttttgttcaaatatggggttttgtgattttggatttacaaatggattgaaatttcgatttcacctcccactcggaacctgatactcagtcacctttagagcagcttccttctctctttttctccaaccatggttgctgatccacagggcatcaaggtttttcagatttgatggcgtttgtttctgtgctcaagcaaaatcaccgccaccacccaacaaacccatgagctggaatttcaattactgtgcatgaagggagttcagacgagaacagtgttttcatgttctccccaacatcaacaagcgctttgtttgtgctgaggaagcactactcaacccttctctaccattatgaacagtgaatctgaagaaatttaagaagttgatccaagagcatggtgatgaggttccgatcaagttatt

SEQ ID NO: 16623 - DNA, 773 bp, Malus x domestica
  misc_feature (622)..(622): n is a, c, g, or t
  Predicted polypeptide sequence is orthologous to G2933
ggatatagttcaaggaccttcgctaccaagcaccctgctttttatcatacagggatatacataagttcttatagagttaaactgtccctcaaagacgtaggacttaacaaattttctctcaatatttttgtacatggctgtcgcacttggtgcgatggcaagtgtcttcgcccatgaagggtaggtctcgggttcgagacttgggagcagcctctccataaatgggggtaaggctagccgacattcacctctcccagaccctgcgtaaagcgggagctttgtgcactgggtacgacctttatttttgtacatggctattattcagaaagattctttttttacataggcactctctgaagtttacttgagtatgatacatgctctcatggttaagagtactagtcttcaaaattcttatgggaatggctctttccttttgtcatgcgtagaaggacataagcttctttctcacactctaatctgtatgttctgtccacctgaagatgtaaattatagaaaaccctgcctccataggactcaaagaaagaagcattttctagttcaagcccctcttcctccagatgttgtaagatctcagataatagattgttgtgggtcttanaggtggatatttgaattgctacttctctatcgttaagacggtaggttgaaactgcaaattgtgaactccgagctgtggtttttatttttttctcctcatgcattgcatcctcttgcttagaagcccttgaaaagagtcttccctctttccg

SEQ ID NO: 16624 - DNA, 700 bp, Malus x domestica
  Predicted polypeptide sequence is orthologous to G2964
acggttcaattgaatctccctctctctctccctttctctctctctaacttcctctctcccagggttccgttttctggaactctctcgctgtttcgtgctcggacgctggtgctctctgtgagctatgatggagttcggaggaggtggccggaagagaggcaggccggaagctgcgcactttaatgggaatggcggcttcaagaaatccaagccagcacttccgggtgcccttttggtgaagggtgtcactttttgcatgatgttcctggtggcatcaaagcagtgtctcagatgactggtagcaatccaacccatcctcctcctcctagaaattcagcagccccgccatcatttccagatggttcttctcctccagctgtcaagacacggttgtgtaataagtacaacacagttgaaggttgcaagtttggggataaatgccattttgcccacggtgagtgggagcttggtaggcccactgctcaatcctatgaagatcctcgtgcaggggcaggatttccaggcaggatgggaggtcggatggagtctgccccaccggcacatggagctgtagcaagttttggggccacagccacggctaagatcagtgttgatgcttcgcttgctggagctattattgggaaaaacggtgtacacttcaagcaaatttgtcgtgtgaccggaacgaagctttctataa

SEQ ID NO: 16625 - DNA, 500 bp, Malus x domestica
  Predicted polypeptide sequence is orthologous to G2969
ggtaatcacgagtactgcagtgtttgtggaattattaaatctggattctcacccaagttggacggaatttccacgctgtcgagtagctccagagcacacgtggcaattccagaggatatcgaggaggagtttcagttcatgaacgtgaagcgggctatgctggtctgccgggtcgtggcgggtcgggtcgggtgtgacactgaggaggatattgacgacgtggacaaagagggcggcggattcgactcggttgtcggcagagaaggcagcggggtccacacgagggtggacgaggaggagcttttggtgtttaatccaagagccgttcttccttgctttgtgatcatatataccatgtaacggtgtgatagtttaagcgtttgatgcatgcaatataaacttgtattagtccttattttttagcaaggattgtgaatatattttggtgatgtgtggtggtgatattgtttgattcaccccaggttttttcttaaaaaaaa

SEQ ID NO: 16626 - DNA, 580 bp, Malus x domestica
  misc_feature (510)..(510): n is a, c, g, or t
  Predicted polypeptide sequence is orthologous to G2981
ttttttttttttgtgtgcatcgcttcataatgtgacatgactatagaatatataatcatcccctccagtccacttctaaggcattaatgaccatccctcgaatcaggtcttctaattggaggtaattgattccgatgttctcggtctctgtcgccgcccggatcggttattactggtggacttggcgtacccgacagtaaattgctgacagacggttgggtagggaaactgggaaggaaaggcaagagtgagaacccatcatcctgccctcgtattctcaaatcgttcaacgtgggtatctcggatcggtcaaatggagtgcgctgaatacaaaatgcttgcgtcgagtaagacgaaaattggcgggaagaagaacgtccagacacgcttgctgatgaacctgttgtttgatgcgaatgggagtttggagaatttccttgattcaatgacaaagccgaaagatcggagggatgacccgctccaaaactgaggcaaggagctgggtgccanagattaagagtcaatccatcatccatatgataagcccttgatggcgaattgtatctctgatcctgttcat

SEQ ID NO: 16627 - DNA, 586 bp, Malus x domestica
  misc_feature (447)..(447): n is a, c, g, or t
  Predicted polypeptide sequence is orthologous to G2981, G2982
ccgttcattcttgtgcagactcgccctcatgcaactgttgaggtggaaatatcagaagatatgcagcttgtgcattttgacttcaatagcaccccatttgagctccatgatgacaactatgttttgaaggcaatgaagttttgtaataggcagcagggtgatgatgcgacacaaaatttaattgtagatggaggcgaaggttgtagcatgtcgggcatgtatcagccacaaatccctctttcttcaatgctaaacacagcaattagaccaccacccatgtcaccaccccttcccggaatactgaaagcacgcgtcaagcatgagcaccatggacaatagtgttagcatctgtatattgtggagagtagtttgccggaagtgaataggtcatcacgcaccctcatgattatcgttgttagatattgccataagttggatttagtttangtttcaaacaggcagatgagtcttggttggtttgatgctcgggaggatgttggccgcggcaaatgctttgctttgctttgcatgtccaatatgtgctattgtaatttttatcccattcttttttaattttaccgttttt

SEQ ID NO: 16628 - DNA, 396 bp, Malus x domestica
  Predicted polypeptide sequence is orthologous to G2983
ttttttttttttgattggaataaaagtgcttttggttccaaaaggcagaattagaagcagagctagctttcagtacaaattaagagacaattacttgcctttcttctttcccgaaacgaataagaaaagaagaaaaccaagaaaagaaggaaagcacatgacattgtcaaattaagcatatcccatcattttcttccttctggatgtaatgggaagagttccagagtcataactccaacactacctcccttaacggcgtcgtcgttgtcgaccttacatactacactaccatggtcaccctctaccaagcaatcaaatccccagctcctacactttctcttgtacggactatcttcctctctttccactactatttctcccagggtggtaattaca

SEQ ID NO: 16629 - DNA, 656 bp, Malus x domestica
  Predicted polypeptide sequence is orthologous to G2989, G2990
ctctctctctctctctctcgccaaaaaaacggaaccatctttatcactcctccatacctcccctcactttctcaacatcctcagagcttccatggcagctcagagctgtaatctgcacagaaatctaatcctaacgacttaaagcagctcccttttaactttctctgtatttgcttttgatttttgttctcattttttggagacccctagatgtttgagcgatggatataaccccgtccatcaccaccaccaccaacaacaccgccagtacaaaatccccggaagccgacagcgaaactccgactcggatccagcaacccttaaagcctctgtccttcagcaacggcgtcctcaagcgccacaaccccacgcaccacctccaccaccaaaacatccccatcacccctgtcgtagtcacctacaaagaatgcctcaagaaccacgccgctgcgctgggtggccacgccctcgacggctgcggcgagttcatgccgtctcccgctgccaacctcgccgaccccacctcactaaaatgcgctgcatgcggctgccaccgcaattttcaccgccgtgaccccgaggtaccccgtgcagccaaacacccccgccgcaacaacgcatgtcatcgagttaccaaccccaccaccggcaccatt

SEQ ID NO: 16630 - DNA, 669 bp, Malus x domestica
  Predicted polypeptide sequence is orthologous to G2989, G2990
accctattgaagttttcacctttgagatttcactccctaatatcaaaaccctaattaattcccaatccgcccgtcaatttcttatgcttcttctcgcctaaagatatggactttaccaccgtgaccgccaccatccaaaccccagatacggacaccgaaccgccgtcgccgacggaccccaaattcaacttcttcagtggcaggtccttatccttcaccagcggcgcattccagcctcagccgaagcgtacaagggtggttgcctacaaagaatgtctcaagaaccatgctgccagcttaggtggccacgctctcgacggttgcggcgagttcatgccttccccttcctccaacccagctgaccccacctcgctaaaatgcgccgcttgtggctgtcaccgcaacttccactgccgtgatcagtacagacccaaaaataatgttattcgcaaccgcctgctaccagcgccgaaaacagctcacaacaaccacagctcaagctccagcccgagctccagccccaaccctactttgagcccgcagtctccgccgccagtctcccacttgcccccctcctatttcgctgccccgccgcaaatgctactcgctctcagctccggcttttctggtccgcccgatgagcacccccaccagcaccagctcaatccg

SEQ ID NO: 16631 - DNA, 648 bp, Malus x domestica
  Predicted polypeptide sequence is orthologous to G2989, G2990
ccccatttaagttttcaactttgagctttcacaccctaagaacaaaaccctaatcagtttcttatgcttcttctcgcctaaagttatgaactttaccaccgtcaccgccaccatccaaaccccagatacggacaccgaaccgccctcgccgtcggaccccaaatccaacttcttcagcagcaggtccttatccttcaccaacggcgcgttccagcctcagtcgacgccaacaatggtggttgcctacaaagaatgtctcaagaaccatgctgccagcttaggcggccatgctctcgacggttgcggcgagttcatgccttccccctcctccaacccagctgacccgacctcgctaaaatgcgccgcttgtggctgtcaccgcaacttccaccgccgtgaccagtacagacccaaaagtaatgttattcgcaacccccaccgcctgctaccggcgccgaaaccagctcactacaaccacagctcaagccccagcccgagctcgagccccaacccaactttgagcccgcagtctccaccgccagtctcccacttgcccccctcctatttcgcttccccgccgcaaatgctgctcgctctcagttccggcttctctgggccgtctgatgagcacccccaccagcacaactc

SEQ ID NO: 16632 - DNA, 621 bp, Malus x domestica
  Predicted polypeptide sequence is orthologous to G2989, G2990
gattgcaaaagagcgaagaaagactggtggaggatttctgcagcgaggtggggattgggaggggagttttcaaggtttggatgcacaataacaagcacggtcggaggagattggagagattgggcagcggaaacggcagcttaggcgacggtgggaatatgaacaaaaatgtcagtgagatcaacggtgatggtgaaagacttggttttgactccatgaatgctcacatcgccagctacaatgtcaatgccaaccccctgaacgaaggcagcagagcaagtttccacctttccaccaatgggtcgtcgtcttcgtcgtgaaccagagagaaagatggaagcttttgggagatattaaagttaattaatcacgcttattagtataaacatctcttgttaattcgctagctcgttcgttaattaatagctaccgcgtactgaccgatctgctactgttttggcgaggccgagaggaagggattagagaggataacgattaaagagaaagttaatcatatgtttagctgaaagatattattcttaatgcaaagttaattagtcgatgtttttagctttccattagtaatataaagttgctttcttatgcaaaaaaaaaaaaaaa

SEQ ID NO: 16633 - DNA, 735 bp, Malus x domestica
  misc_feature (621)..(621): n is a, c, g, or t
  Predicted polypeptide sequence is orthologous to G2998, G2999
ggagatcatgatccaaacacaaacgaagtatacagagagtgcttgagaaaccatgcagccagcctcggcagctacgccacagatggctgtggcgagttcacacttgaccacgcatccccaggcggcctacaatgcgtcgcctgcggatgccaccgcaacttccaccgcagagtcacttacgcagccacgtcatcgcaagctgcaggaggcggtagatcaggacatcagcaacaccatgtcatcatgagctgcagtagccgaggtcgagatcccgccgaaaatatcataacacaagaccaactcattgactacaatgccggtggaggtgggtcgccggacagcggagagaggatgagcagcgggaagaagcggttcaggacgaagttcacggcggagcagaaggagaagatgctggcgtttgctgagaagttagggtggaagctgctgagaaaagatctagaggacgagatagagaggttctgcaagagtgtaggggtaagcagacaggtgttcaaagtgtggatgcataatcacaaaaacctttcatcttcttctacttctgcatccaccggcaatgcatcttctctcactacccagtagtaccacctctctactctctangcactaattaatcctcttaatccatcgctttagctttagccttttattttctttcctttttattatttggacgtgtttggtcctcatcatttagtccttttttattttcttttt

SEQ ID NO: 16634 - DNA, 696 bp, Malus x domestica
  misc_feature (618)..(618): n is a, c, g, or t
  Predicted polypeptide sequence is orthologous to G3055
aattgtacttccaaattcaaatggattatggtagagagagcaatgcggtccaggtagtcactgggaatagtggtggtgatatttggtctggtgaccaagcggtttgggctactgaggatgagtaccgagtttggaataatggtgacgcgatggcggacaccatgtccaactcaagttatgatcaaaggcaatcgcaaagtcactctggaagcgaacctccaaataagaaatcaaggaactcccaagatgcaacttcatctaaccggtcgaaagccattgggaaaatgttcttcaaaaccaaactttgttgcaaattccgtgctgggacgtgcccctatgtcaccaattgtaactttgctcatagcattgaggagcttcggagaccgccaccaaattggcaagatattgtggctgcccatgaggaagaaaaggctgtatcttcagagccaagggaagagtatcaaattccaatcgtctctacaggttatggtgtggagactccacgatcctataaagggaggcattgcaagaagttttatactgaggaaggttgtccttatggggataattgcacttttcttcatgatgagcagtcaaagaatcgagagagtgtggcantaagtttaggtcctggaggatatggcggtgctgctgctgctgtgaatggagcaaataacaagccatcaaactggaaaa

SEQ ID NO: 16635 - DNA, 595 bp, Malus x domestica
  Predicted polypeptide sequence is orthologous to G3059
gaaacaatatatttacactaaagaaaaaacgtactggtttttttttttttgttttgtttcaaaacgagtctgagacgaccaactgcagcttctcctgctcagtaagcgagtgacggaagtggcaccggtgaccgtaaggacacgcgccaccagctaacaccatccggcagagctgagtcttgtagcgcgggtgcctcatcacgggacggagctccctaacgccgtgagcaaactggcaattctcctggtacggacacgtccccgtctcctcccacttgttgcaaagctccgtcttcagcatgccctgattgaacaccttcatctggctttgctgcactttcccacacactaccatcacccactttataatcttaattataattaatcatttaatcaaaattcatttaattcggtttaagtaattgaaagtttgcaaatttaatttaactcacagtcatcggtctagaaacgctcaggacacgtggtcgattcgaggagcgaacggaaatgctcttgggaagcgagatccggtccgcgtcgacgaatctgtttcgctccatgacgctcgtcggactgatatcggaggattcctcgg

SEQ ID NO: 16636 - DNA, 422 bp, Malus x domestica
  Predicted polypeptide sequence is orthologous to G3060
tcaaatcccaatctcaggaacattgaactggaggggacctttgaacagattcagcaagctagtgccatggtcagcgagctaattgcgactgtttcaatctccggccctggtaaggctccaggaggaggaggaggaggcccaggagccccagcccctccaggaagtaactataagacgaaactatgtgataattttaccaaggggacttgcacctttggagaaagatgtcactttgcacacggggctgctgaattgcggaagtctggagtgtgagtgctctttgaaattctttttcttgcagtcaggatcttatactagtgggagagctgttttgatttgtcgatgtgcgatgctacctagaggaattaacaagattatgatatcatagtttttgtgagcaaaaaaaaaaaaaaaaaatcgtg

SEQ ID NO: 16637 - DNA, 388 bp, Malus x domestica
  Predicted polypeptide sequence is orthologous to G3061
ttttttttttttaaaaaatgaagaacgttactaaattacttagtacttgatatcaaaaacaaaaaattggatccaagaaggataccgaataagctctcatctttttaagaaatttacaaacaaacccttaacttcaaagatgaacgtacaagaagagcgtttcgtgtgtaaatttgtaataatttcttaaacatggtcctttaatggcttaacaataacccgaatacatttctagaaccgtaaatccgcctaagatggtggtatcagcagatagatttcgggcaatgaaactttgtcgatgaactaccggctgcgaagaatgcaacagttacagtgaacctaaccttgaatttctgctcattcgttttcagtttcagcttccatggca

SEQ ID NO: 16638 - DNA, 642 bp, Malus x domestica
  Predicted polypeptide sequence is orthologous to G3067
cgcccttttttttttttaactaatgaatgattttcacccaaaagcacatttttttatatgcttcaactttccaaacaccaactgaagacaacagatttactgagctattttttcctcctcctccaaaagcaaaaaagatgaaaagaatcttcagggtttgcagatgaccagaaagcagggaaggagagctctaggatttagcagataaagctcttcaatgttagaataaagccccatttttccagccaatgaatcgaaccccgtttgcccagtaatttcctgaatattttccaatggcttatgcactctcccagcaatcactctgcacactatcaaagccttccttagagttgcatcttcctccaatatttgaattgcttcaaaagctcttccacttgtagatgttgtaaaaacaccaacaccttccttgagctcctttttcgcagagaacccgttacgtatgatcctacaaacgctgcatttctccaatacgcaaaggctcgaggagccatttaggccgagacagcaggccacggtggtgccataaaaccccaaaagctcattcccatccgcactgcccctagggtggcctcttgggcagcttgctggcttttggactctccccctcacaacacctttaaa

SEQ ID NO: 16639 - DNA, 543 bp, Malus x domestica
  Predicted polypeptide sequence is orthologous to G3067
aaacttgaagaaaaaagtggaaaggtttgaaaagtgctgttggaggaaggagaaaaaggggtattatcaaattaatcaaaaaatgccaacagtgtggttttctctgaagaaatctcttcactgcaaatcagagccatcagatgttcatgatccaaggggcaggaagcaactgagcacaatctcgactagaaaagcaggaggaggaagatcagggtgctcaagatccatagcaaatctcaaggatgtgattcacggaagcaagaggcatatggaaaggccaccaagtaattgcagcccaagatccattggaagcagtgagtttctcaacccaataacacatgaagtaattttgagcaactcaaggtgtgagctgaaaatcaccaccaaccttggtggcttccaggacggagttgggggtggaaatgccaacaatggcagcggtggtggcagtgtcggtggtggttcaacttttgttgataccctaaagccaggcacacctggtcctggtgggcaccctacaatgcactacttcaatccatcttt

SEQ ID NO: 16640 - DNA, 578 bp, Malus x domestica
  Predicted polypeptide sequence is orthologous to G3074
ggctggacctatctccgagcctaaacatgaagaatatcctgggtggtctctctctgatgtggatggaatggccattgatcctgttcaacttgcaaatctcagcagaaggctagacgaggatgacgaagattatgacgaagagggctaaattcctctcgatggcttattgtcccaaagtagggtagcgggatcaagatcagtggaaagctcttgaaggaaaactaaataaaagtatacaaaagctggaatagcgacctaaatggagatgaaatggcccgtgcactttgtcccaacgaagagtccgaatttctcttcctgtccaatgttagtatcgtagcatttcctaacatccatttccagaggtagcatttccgtgacgatggcagagaggatagcctctgcaaattgactcttagcagtgtatgaagaatatggcacccttgaatagcggtggattgccctatgagtggtttgcctttttaatttactgtgtttgttatagattttcaggacaagtagtagcttgctcgtcgttatcgcgtggaaggtaatagttctgttagccctttcaaaaaaaa

SEQ ID NO: 16641 - DNA, 622 bp, Malus x domestica
  Predicted polypeptide sequence is orthologous to G3074
cgttgctgtcgcttcagcagaccattatacctaatccaaaccctggaatggtggcggatgatgtttccgagtcgaaggatgtattgagggaaaatgtcactgtccctgatgaaactgatccagcagttcgaaattttgatctgaatgctgatgtaaatgataacgaggacacaaaagctgcagcaagagcagcccaagctggagcaatggcatcccaagcagccccagtggcatcccaagcagccccaatggcagcccaagctggagcaatggcatcccaagcagccccagaggcatcccaagcagccccaatggcagcccaagcctcatcagccggacctatttccgagcctaaacatgaagaatatcctgggtggtctctcgctgatgtggatagaatggccattgatcctcttcaacttgcaaatctgagcagaaggctagacgaggatgaagaagattatgacgaagagggctgaattccacttgatggcttattgtcccaaagcagggtagcgggaacaggatcagtggaaagctcttgaaggaaaattaaataaaagtaatacaaaaggtggaatagtgacctaattggagatgaaatggccagtgcactttgtcc

SEQ ID NO: 16642 - DNA, 335 bp, Malus x domestica
  Predicted polypeptide sequence is orthologous to G3083
actctgacaaaagtggtggaactgctgactccacagcaggctgtggagttcttgattgcagctgccgagttgcagtttggtgtccgcggctgggggttgaatcacgaccgtcggcgtaagaatgtgtgaatttcaggtatgttaatcaaacagcgtttttttgatcgtcggcggaagttaatccggtatacaccgtcgttaatttgtttgcagtcttgaagcactaccaacatattgtatgcaggctgcttaacggtgatcttttcgtgttttgtatcctcccatcagcaccgatgatcaaataaagaattaatcgtatttactttcaaaaaaaa

SEQ ID NO: 16643 - DNA, 435 bp, Malus x domestica
  Predicted polypeptide sequence is orthologous to G3086
atctgagtccaccaaaaaccaccgtgcatccagttgtgtagcgtgcccgtccgaccagcgagcgacgccgtcattgctaatcagagttcaccgaaccgatccctacatccactcgccatgactcactactgcatcacgtactcacgtacccacgaattgagacccaacccagaaatctagccactgctgttgactgaagcccataaacgtacccacatcaccgccacgcccaccatactcgcctatctcccagattgtcatccactgctgcactccctgtacacgcatcctcgtcgccgctctaatctacacccactgtcgctgctgccccattaggcaaaaaatccgcaagtgcttctgcccacagacccatgttttgcaaaccagcctatgctttgtataagtcaaggaaagaaaagaaaacaagaaaacaaa

SEQ ID NO: 16644 - DNA, 801 bp, Malus x domestica
  Predicted polypeptide sequence is orthologous to G3091
actcgcaagaacacattttctctctctactttctctcctttctctgtgttctctcatctcagcattgagcaaaccagtgttcatttctgttcattcaagctggcgatcgagaatcaagacaccacggtcagagaaatcaagcccaagagcaggagaatcatgggtgctggaggtcctgacgaggacgacaataggtggccgccatggctgaaacctctgctaaaagagaacttctttgttcaatgcaagcaccacgctgactctcacaagtctgaatgcaacatgtactgcttggattgcatgaacggccctctctgctctctctgcctctcttaccacaaggaccaccgtgctattcagataaggaggtcgtcttaccatgatgtgataagggtgaatgagattcagaagcatctggacatcagtggagtccaaacctacattatcaacagtgcccgagttgtgtttctgaacgagaggccacagcctaggcctggcaaaggagtcacaaatacctgtgaagtctgtgaacgcagcctcctcgattccttcagattctgctctcttggttgcaagattgtggggacatcatccggtaatccccagaagaagaacaagtactcgaaggcaatggggggttccgattcagatgactcgtacagcagcagcagcagccacggaattgcaaagttcaaaaacagcaaccacaacaaagtccagagcttcacaccgtcaacgccgcccccaacttccactaattacagaaacggccagaaaccgaagggcattccccacaaagcc

SEQ ID NO: 16645 - DNA, 797 bp, Malus x domestica
  Predicted polypeptide sequence is orthologous to G3091
ctttctctgactataacacattttctctctgtactttctctctgctttctcatctcagcgttgagaaaaccagtgttcctttctgttcattcaagctggcgatcgagaatcaagacaccacggtcagagaaatcaagcccaagagcaggagaatcatgggtgctggaggtcctgacgaggaggacaacaggtggccgccatggctgaagcctctactgaaagagaacttctttgttcaatgcaagctccatgccgattcccacaagtctgaatgcaatatgtactgcttggattgcgtgaacagccctctctgctctctctgcctctctaaccacaaggaccaccgtgctattcagataaggaggtcgtcttatcatgatgtgataagggttaacgaaattcagaagcatctggacatcagtggagtccaaacctacattatcaacagcgccagagttgtgtttctgaacgagaggcctcagcctaggcccggcaaaggagtcacaaatacctgtgaagtctgtgaacgcagcctcctcgattccttcagattttgctctcttggttgcaagattgtggggacgtcatccagtaatccccagaagaagaagaacaagtactccaaggcaatggcgggttccgattcagatgactcgtacagcagcagcagccacggaattgcaaagttcaaaagcaatagccaccacggcaacaacaaagttcagagcttcactccatcaacgccgctcccaacttctgctaattacagagcggccaggagacggaagggcatcccc

SEQ ID NO: 16646 - DNA, 668 bp, Malus x domestica
  Predicted polypeptide sequence is orthologous to G3095
tcgtttcttagccaagaagaataccagtcccggaagacttgcagtactagtcctcctttgttcaagctctctctacccactaccaatttcagaacgcctgcctacctgccttcaagttctaagaaggattcaatcttaatctaagcgtttcagattcagagtgcctatcgacaatcagcaagagaaagaagaagaagataagagagcaaaaacacaagagaagagagacatggtgagttcaattgtaccgatagggcgaattgggagggacgaagatgattcgatttgtccggcgtggttaaaaccaatgctgagagcacactacttcgtccattgtgagattcacggcgattccaacaagagtgaatgcaacatgttctgcttggattgcatgggagatgctatctgcccttactgtttgatccatcacaaagatcatcgcgttgtccagataagacggtcgtcctaccatgatgtggtgagagtgaatgagattcagaagtacatagacatatcgtgcgtgcagacgtacatcatcaacagcgcaaagattgtgtttttgaatgagaggccgcagccaaggcccggaaagggagtcaccaacacttgtgagatttgctgcagaagcctcctcgactcctttaggttctgctctttgggttgcaagc

SEQ ID NO: 16647 - DNA, 539 bp, Malus x domestica
  Predicted polypeptide sequence is orthologous to G3095
tgcattttcctctgcaagtactctgagcctgcaaatttcaccgtttcggccattgggttcacaaaaagttccaatccaagcaaaagcatcacatttttctagataccgatttgctcgcaatggacaggacaatgctggtgccgccatggctggagcagttgctcaccacatcattcttcacagtctgccgtacacatggagacgccgccagaagtgagtgcaacatgttctgcttagattgcagtggagacgctttctgcttttattgcaggtcctccggacacaaagatcaccaagtcattcagataaggagatcttcataccatgatgtggtgagggtttcagaggtgcagaaggtattagacataaacggagttcagacatacgtgataaacagcgccagagttatgtttctgaatgagaggcctcagccgaaggctgggagtaagggatctccccacatttgtgaaatctgtggcagaagcctcttggatcctgttcgtttctgctcactcggctgtaaggttagcatttcatta

SEQ ID NO: 16648 - DNA, 643 bp, Malus x domestica
  misc_feature (590)..(590): n is a, c, g, or t
  Predicted polypeptide sequence is orthologous to G3111
atgtttttcaccggaaaaatccccttcttactccgttcttttgcatcttaacctttatcattgtcctgatcactccactcttgagcatcttaatcgttgttgttgtcatgatcgtccgcctggtgctgtggcttgctgcattgttcgaccgtcacatggccagatctagcgcttccacgcctcagcctcccaaccctttgcctgaccaaggactcgaggaaatgattatctgttcgcttcctagcgtctcgtacaatgcagaagcggatgcaagactagcagaatgtgcaatctgcttgatggagtttgtggatggagatgtcacaagggtgttgcctcattgtggtcacggattccatgtgagttgtgttgataggtggctgaggtgccactcttcgtgcccgtcttgtcgcggcagtgtggttgcggaagaggggtgttacaaatgaagttggtatcgagctcatggattcggagtttggagctctgataagagggagaggaaaatatagaaaaacagatcatgtaattggcctgaatcattaacagtttgattcaagccgctgcaattttcattcaattcgaagcanatgtaaaatttcgacatgtaaattagtaaagcaatcacctttcccaaaaaaaa

SEQ ID NO: 16649 - DNA, 810 bp, Malus x domestica
  misc_feature (606)..(606): n is a, c, g, or t
  Predicted polypeptide sequence is orthologous to G3111
attgaatatttccacctctggtttctgaaaacgacattagattatagatataccgccgtatgatcagccatgcctcgctctcaaagatttctaggcagcagcaccccctccgccaacttctcaaacataacagcagctccgcctcctgaggccgtggttctcgagtcggacttcgtcgtcatactggcagcgctgctctgcgccgtcatatgcgtggtgggtctactcgccgtcgcacgctgcgcctggctccgccgcggatccgagggcagagccgctatcggatcggcttcttcatccgccaacaagggcctcaagaagaaggtcctccagtcccttccgaagttcacgtacggaaccggcggcgccgagcccccgccgaagctgggttcggagtgcgccatctgcttaggggagttcgcggaggggcacgagatcagggttctgccgcagtgcgggcacgtgttccatgtcgggtgcattgacacgtggcttggatcccactcctcgtgcccgtcgtgccggcagatcttggtggtggctcggtgtcacaagtgcggtgggtttccggctccaatatcagaggcggagctcaaggctcacccngaccacaccaaccattcagctccctcctccggcagcggcggctgcaactgcccccagtactgccattagtaatcatttccttctaataccgctacaactacccatttttccggccttaaaagtttgctaactaaccaaaaccccctttttttaaaattttttccttaaattttaaccaagcccccttttttattttttttcttt

SEQ ID NO: 16650 - DNA, 650 bp, Malus x domestica
  Predicted polypeptide sequence is orthologous to G3967
cctcctcaaggtcttggagtatcttcctcgcggaagtccttctgaggcatgtcttatgaagatatttgttgccactgttgaagcgattcttcagagaacatttccgtccgagtcctctagagagcaaaaccggaaaacaaggtacctttttggtatggggccagcctcaaaaaacctggctgttgcagagctgcgtacaatggttcattcactattcttagaatcatgtgcctcagtagagcttgcttcacgtctactttttgttgtgttaactgtatgcgtcagtcatgaagcccagtccaatggtagcaagaaagcaagagttgatgaaagcttcccaccagatgagagcattgaagaatcagaaaagatgtctggtatgcagagagacagaactaaaatgaccaaaaaacaagggccagtagcagcatttgattcttatgttctggctgctgtttgtgctcttgcatgtgagcttcagttgttccctttgatttcaaaggggattaatcatagtcactctaaaaatgcaaaaaatgtagcgaagcctgccaaagtaaatgtatgcactactgagtttcgaagtagtgtagactcggcagtttgtcacacacgcagaattttatcaatcttggaagcactttttttgc

SEQ ID NO: 16651 - DNA, 555 bp, Malus x domestica
  Predicted polypeptide sequence is orthologous to G3967
ttgttgatggagaagcttgcaccttacctcaactggagctactggaagcaacagctagagcaattcagcctatgctagagtggggagaatctgggctggcggtctctgatggcctttcaaacctgttaaagtgtcgtctgccagctaccatccgctgcctttctcatcctagtgcacatgttcgtgctctgagcacatctgttctccgcgatatcttgcaagccagttcaataagacccaaccctaatccggtggagataaatggtatccatggtccgtcgtataagtattttaacttagatgtcattgactggcaagctgatattgaaaagtgcttgacatgggaagcacatagcagactcgcgactggaatgcatattaaatttctggatactgccgcaaaagaactgggttgtagtatttccatatgataacgattagcttcttccagtgtataatttttttcatgtgagacatatacacaacagatacttgcatctttgttccttttaaaaagatacgagtttgcaggtaagtagatgttcattttgttct

SEQ ID NO: 16652 - DNA, 744 bp, Malus x domestica
  Predicted polypeptide sequence is orthologous to G3967
ttaatgcaagttccaatttggagggattccttcgtgtgttttgaaggcagaaaactcagtcaaggtggaaacagtagatgctctaatgtaggtcagccatctgccttgcaatgtgaggattcttcacattcagaatttaaacgcaaatctgatattgcatcatgttcaaatgaggggtccggaaatactattggtaaaggtgttgcaagtttcccattagatgcttcggatttggccaactttcttactaaggacaggcatataggatttagttgcagtgcacaggttcttcttagatccgtactcacagagaaacaagagctgtgtttctcagttgtctcactgttgtggtacaagttaattgcagctcctgaaacccaaccttctgcagaaagtacttctgctcaacaaggatggcggcaggttgttgatgcattatgcaatgttgtctcagcaacaccaaaaaaagcagccacagcagttgttcttcaggcggagagggaactgcaaccttggattgccaaagatgatgatcaaggtcagaagatgtggagaatcaaccagcgaattgtgaaattgattgtggagttaatgagaattcatgatagcccggagtcattggtaattttgtcaagtgcctcagatctacttttgcgtgccaccgatgggatgcttgttgatggagaaccttgcacccttcccccactggagctactggaaacaacacctaaagcaatttcaccc

SEQ ID NO: 16653 - DNA, 620 bp, Malus x domestica
  Predicted polypeptide sequence is orthologous to G3967
atcataacgtctcttcggaaaagaaaattttgacaatatatccacctttatatccacaagaacaaaatgaatatctacttacctgcaaactcatctctttcaaggcaacaaagatgcaagtatctactgtgtgagtctcacgtgaaaaaaaattatacaccggaagaagataatcgatgtcacaaggaaatactacaacccaattcctttgcggcagtatcaagaaatttaatctgcattccagtcgcaagtcggctatgagcctcccatgtcaagcacttttctatatcaccttgccagtcaatgacatctaagttaaaatacttatacgacggaccatggataccatctatctccaccggattagggttaggtctaattgaactggcttgcaagatatcgcgaagaactgatgtgctcagagcacgcacatgtgcactgggatgagaaaggcatcggatggtggctggcagacgacactttaacaggtttgaaaggccatctgccaatgctaacccagattctccccactctagcataggctgaaatgctcaacctgttgcttccagtaactccagttgggggcagggggcaaccttcccatcaacaaaccccccatc

SEQ ID NO: 16654 - DNA, 678 bp, Malus x domestica
  Predicted polypeptide sequence is orthologous to G3967
ttacgaggaaaactacagcatcttaaaaatattccaactataaaggaagataaaaggaaaataaataacgaagctgattttacagtgaacactttccagcattaagatccgaaacatttccaagaaaaagctctcagagaagccccagcaatcagattgctgtaatttggcatgaagttatcaagatttgaaagttttgaagattttgtgaaaggcacagacttggatttgtgaagaacagagggttggaaagctttgtggaatttcttgtgtgtcgttttattgtggttgcaaagtcgccgttttggcgctggattaaagttatctgggagattaagcttctatggctgctacatctgaaagatggtttgatcggctgcagttctcctcattgtttgggccgcccccgcaggacgccctacgacggaaggcacaaattactgcgtatgtggactactttggtcagtttacatcagaacagtttcctgaggatattgctgagctgatccgcaaccgttatccatcagaggtgaagcgtctctttgatgatgttctagctatgtttgtccttcatcaccctgagcatgggcatgctgttatccttccaattatttcatgcatcattgatggtaccctggagtataagagcagtagccctccgtttgcttcgttcatatc

SEQ ID NO: 16655 - DNA, 879 bp, Citrus sinensis
  misc_feature (38)..(40): n is a, c, g, or t
  Predicted polypeptide sequence is orthologous to G28, G22, G1006
ggggaaacacagtacagatcactctcaaatccaagaannnacagcaaaatcataacatcatattccccggcaaattaaattcaagcttaacttttcgtttacagattaaagtttcagcttcagtgatacacataaactcttgaactcaagccctaactctgattcaatccattgaaatatggaggattgcgaagctttacacgacactgttaaggaggggtggatttcgtttgatcagcttgatggaaagtcgacgcctcatgctccgcctcaggctcaggctagtggatttcgtttacagaaggcagccacgatgacacgtgagattcacgtgcgtgtaaattatcgaggtgtgaggaagaggccgtggggaaagtttgctgcggagataagggatcgtaaaaagaatggctcacgactttggctggggacctatgatacgcctgagggtgctgcgttggcttatgatagagccgctttcaagatgcgcggctcaaaagccaagcttaattttccaagcctcattgcctcaaacgttgagcctcagcctcacggaattacgaaaaagaatatggcttcttcttcgtcatcctcatccatcgctgcagattaaatctccgaatttgggtttaattagctgagaaataatatttctacttatttttgaagtaattgacattaattcgccttttattaatattaatgttgtgtgtatatatatgtatgtatgtatgatgtatctgccctgcttcatgtatcgtttgggtgatttgatgatccgtaattgtaacaactggtgcaattcataacttgaccccagtccatcgatcaatgtacgtaacgattttcttaaaaaaaaaaaaaaaaaaaaaaaaaaaa

SEQ ID NO: 16656 - DNA, 760 bp, Citrus sinensis
  misc_feature (13)..(15): n is a, c, g, or t
  Predicted polypeptide sequence is orthologous to G28, G22, G1006
gcgggccttcagnnncattaccaatcaacaataatgaaacattaaattcccctgtttcgagcttcaatagtttctccttcacagagaatatcaatgagtatctatcacaaggggttagctctagctcgcactcctccttacatgacggcgtcaatggagggtggatttcgtttgatgatcagcttggtcgtaataatgatattggaagtgcaatagcaaatattgatacgagtatgacttctcctcctcatcctcctcctcttccaactccacagatggatgtggcacgtgggactcacgtgaggatgcagtatagaggcgtgaggaggaggccgtgggggaagtttgctgcggagataagggaccctaagaagaatggggcaagagtttggctgggcacctatgatacccctgagggtgcagcatttgcttatgatagagccgctttcaagatgcgaggctccaaggctaagctcaattttcctcacctcattggctcaaatgttgagcccccggttagggttaccaagaagcgtgggtctccagagcctccttcctcttcttcgtctctttcttcatcatcatccgttgtgtcctttagacccgggtgaattaattattagtatcagagctgctttgcttaattttcttagattcaaatttacataacatgtaatcgtacttcttcttaataatttcttttcaaatcgattgccccgtttaccccccgaaaaaaaaaaaaaaaaaaaaaaaaaaaaaa

SEQ ID NO: 16657 - DNA, 731 bp, Citrus sinensis
  misc_feature (689)..(690): n is a, c, g, or t
  Predicted polypeptide sequence is orthologous to G28, G22, G1006
ggggaaagttgcaggtagcagttgcacactcacaattcacaaagaaagttaacgacaaggaataggaaatatatacataaaccaatttctgtttttaaatccggaagcaaaatgcacggacacagtagtagtggtggtagtatgaatatgatgccgtcggattatgctgtgctggattcagttcgccagcacttactcggcgaatcggagactggactgagcagcgtgtcatcagcgagttccaagtccaacggggctccccctacttatttcaggagctcaagctttagccgattgtacccatgtctaacggacaactggggggacctccctttgagggagaacgactccgaggacatgcttgtctttaatttcttgcgtgatgccctaacagttggatgggttccacaggagcagttagccgaatctgatcgccatcaggtggcggaagtggcgccggcaccggcgttaccggaggagcgaggtgctccggctcctacagtggtgccttctagggggaagcattacaggggggttaggcagagaccttgggggaagtttgcggccgaaatacgtgacccggctaagaatggggctcgggtttggctcgggactttcgagacggctgaggatgcggctctggcttatgaccgatccgcttacaggatgaggggatcaagggctctttnnaattttcccctaaggatcaactcgggtgagcccgagccggt

SEQ ID NO: 16658 - DNA, 870 bp, Citrus sinensis
  Predicted polypeptide sequence is orthologous to G28, G22, G1006
caaaaagcaaaaatgatttctcatcttcaccatcatcaatatcatggaagctcaagctccaataaaaatgatggtctcgtgatcagttcttgtttaacagagaactggggagacttgccgttaagagttaacgactccgaggacatgatcatcttcaactacctccatgacgccgtcaactcaggctggtctccgttagattcaacggcaacgtctagcgtaaaagccgagtcagtaagtgataattacaaaaataataataatatcaataatcagaagatgtgtagaggagggaggcactatagaggagtgaggcagaggccatggggtaagttcgcggctgagataagggacccagctaagaatggagctagggtttggcttggaacttacgagacggctgaggaagctgctctggcttatgatcgagccgcttttgatatccgtggctcgaaggctctgcttaattttccccacaggattggctccgacgagcctccgccagtcagagttacggctaagcgaagtcattcggtagactcggcggctgcggctaagaggagaaaagattcagcggcggctaaggagcatcaattgaccatgctgccagctggcgagcacttattggtaaattgagttttcggaaatcaaatgacaattttggtttgtgctgtgtacaaaattgtaacagtggttcaaaagtccagagtaatagtaacactactattccaaaataagaaatagcgaagattgacactttctcctatagtttctggattttgctgtttattttctatggtttttattatactgttgtattttctttttctttttttttttatgtcataatttttaccaaaaaaaaaaaaa

SEQ ID NO: 16659 - DNA, 439 bp, Citrus sinensis
  Predicted polypeptide sequence is orthologous to G28, G22, G1006
gaattcggcacgtggcctcgtgccgaattcggcacgaggtacgcctgaggatgctgcattggcttatgatagagccgctttcaatatgcgcggctcaaaagccaagcttaattttcctcacctcattggctctaatgttgagcctgtgccgctcggcagagttacgaagaagcgtgaatctccggagccctcttctccttcttcttcttcttcttcgtcgtcgtcgtcgtcgttcacagtgcttagttacgattctcccaagcctaagcggagaaattatgggataagtttctgtacatctgatgtgaactgggaaaatgttcaataatatccgcgttattttgcaaaatgtcacttctagaagcaggtttcttggattcatcactttatgtccttgataaatgatatatgacaattactaaaaaaaaaaaaaaaaaaa

SEQ ID NO: 16660 - DNA, 588 bp, Citrus sinensis
  Predicted polypeptide sequence is orthologous to G47, G2133
ccccggaggcggccgcgatggcccacgacgtcgctttctactgcctgcggaggccgcggtcgcttgacggccttaactttccgtcaatgttgccggcaagcgtcgtccatgcagagctgtcgccgaaatccgtacagaaagcagcttcggacgctggcatgggagttgatgctcagatggttttaaacaaagacaagactgatgaaaatgaaaatgaaaatgaaaatagtggagcgacgcaagtgcttgatgagaagcagttttgggaatatgattacgagtttgaagattgtgggacatcggaagagggagagttgaacatttctgttgaagattatctcaagactcaagtcgatcattaggtcttttttctttttctttttatttttttggatagtaataaatatatagtttgagaataagatttgtaaaagaccaaatgttgtcttaaaaccaaaagtgcagtctgaaaatttttcctaatagttgaattgctggggccacttgttcgagtctttatgtgaatttcttttctcttttcacaaagacgtagaatagcagaaattctataaaaaaaaaaaaaaaaaa

SEQ ID NO: 16661 - DNA, 784 bp, Citrus sinensis
  Predicted polypeptide sequence is orthologous to G481, G482, G485, G1364, G2345
tttttttttttttgttcatgcaatcatctattaaataaagaccctaatttacagcactaatcatcggactaccacagttgttttgttgataagggcacgtaaaagacaaagtgaagggaaaaaaatccgaaccaccatcaccctcaacaacaaacataaaaggaaaaaaatctgaaaaaatatagaacttcagatcaagcagataagttaatatcaaagatgctataggtgttgaaactaaacaatttgagcaaccctaaaatcataaaatatgtgacagtgaagctagaaaccacttattcatttccctgcatggatggaacgatcatatgctgcccctgtgcttggggattaacatagttgagtggaccctgaagagcatactgtgcattttggccaggcagagctccgatcgtgtcccttttagcagatccatccccacccctagcagatcctttggtgtcaccctccatctccctgtacctcataaggtatgccttaagaggatcaatataatcttcaaaacccagagttgccattgcccagagcaaatcatccccattaattgtcttcctcttctccttctgacacttatcactcgcctcgctggtaatgaagctgatgaactcagagacacattcctgtacagtatccttagcatccttagcgatcttgccattagcaggcaaagccttcttcatgatcctgctaatgttagctattggcaaatacctgtcctgctctctcactcccccagcgtgcgggctctgctctcccccgctct

SEQ ID NO: 16662 - DNA, 885 bp, Citrus sinensis
  Predicted polypeptide sequence is orthologous to G481, G482, G485, G1364, G2345
tttttttgcacataactaaaaatccctttcatatatcatacaacaacaacaattacatcaagaggctatgaatggaacatagtcactgtgaatctcactcccctcaattagtacttaactatatatatatatatatatataaattctttacccaaaactcacataaataaacataggaaaaaaaagaattacctaatcatgttcatatatgataatatgatataacaatttaaggtctatctaaattaagctatataagtcccagaagctgatgctccaaaatagacctaccttgacctaatagctccactgctgccaccgccgcctctggcggaggcagcagctgacgcagcgggggacccactctttccagcacccatctgatgatgctgatgaaatccaccagagccataaacgtgtccttgatgtcccatcatcatcatcccaccgtacatccctccattgtaacccccaccagcaccgccaccaccactggccccaccaccagccgctgctccgccaccggctgacccagcgccgcctccgctaccaccgccgtccttctccctacccatggaagtcttctctccctccatctccctatacttttgcaaatagaccttcaagggctccacgtactcttcgaagcctaaagtcgtcatggcccacaacaaatcatcaccgttgatcgtcttccgcttctcgcgctgacacttgtcagaagcttcgccggttatgaaacttataaactccgacacacactcttgcactgtctctttagcgtcctttgatatcttcgcattcgctggcaaagccttcttcattatcctgcttacattggctatcggcaagaaactgtcctgttctctcgccgacagctcgctg

SEQ ID NO: 16663 - DNA, 838 bp, Citrus sinensis
  Predicted polypeptide sequence is orthologous to G867, G9, G993, G1930
gaactctctcagcctcttcttacttttacagaaacctcatattatctacaacacaaattgtttggatcctctaaaatattgactccaaacaatctgactacaccgatatttggaacttggctctgcatctcttcaaagcctgacccatttccattttgttgcagcttgcaatcaatgaacaactttgaattagacccaacaatagatctccaaaagctcaccgtatctccagctttcacgcctttctccttaacgaatctgctccacccctttgtcaacacataactctggctgctactccaataacagtacctcaacctccaaactttctgagtactatcctcaaaattcagcaacacccccttggaagcaatttctgagcttaatgcaaagtgcttctcagcttgttgctttggtatcaccattctgtttaacttccccacatcacttggtgtaagcactttctcaaaaaggaattcaacaggtgtttcctgaaaacaatttgacccaaacaggtcactaaaacctgagctattattataacaactaatgccgacacatgcataattttgtttgctttgctcaagctcatgcttataagtatgcttccttagcatatcaacaatctcagccttagaatgtgagctcaagaaaatcttctccatgtaatcgtcttcgtcatcagtctccaatgaagttctgaaatttgtgattgcattttggccccggaacctcagtgctgcagtgtcatagaccctagcagcttcctcttcttcaatgaatgtaccaagccacacacgttgatgcttctcatatatttgtgcaccccatctgccat

SEQ ID NO: 16664 - DNA, 904 bp, Citrus sinensis
  Predicted polypeptide sequence is orthologous to G867, G9, G993, G1930
tttttaattataaaattttgttacaacctaatttcagctttcttcagcttttgtcacttgtaatttacaattcaaccttttccttttcctttgcaacttgcaactactggcaccacccttccccagtctcttctttccccttaaaactcctcaaaattccaaaaactccaaaaggaaaaaagaaaagaaaaattacaacaagaaataagattacaaaaaagaagaaaaaagaaaaaagatgttacgaagctccaatcattctttgttttttgctgcactctagagacaagagctccatttctctaagccttttgccgtcgttattattattaatgttgcacccaatcttatcgacaccaacaagaccattcccaggaattttgaaaatgttgaccccaaatagcctcatcatctggaccggctcgaccgggttctcgaccggtcctgttctggctttccaatcaatgtaaagctgcctatccccaccggtcgatctgtgaaagctaacaatgtcaccggctttcaaattcttctccttgacgaaccggctccaccctttggtcaaaacgtagctttgactgctgttccagtaggagtacctaaacctccaaactttgccggtgacatcctcaaagttcaagagcagtcccttggaagtgcttccgctctgtaaagggaagtgcttctccgcgtgctgcttgggtatcacgagccggttcagcttccccacgtcacttggggtaacggccttttcaaaaagctggtcacgcgctttaaggacccggtctgaaccgaaggcagtggcaacaccatcaccttccccgtgtttgattacacgcttgccgttggcatcgaggccgtagtttcttttgctctgctcgagctcgtcgttgtaagtgtgctt

SEQ ID NO: 16665 - DNA, 801 bp, Citrus sinensis
  Predicted polypeptide sequence is orthologous to G1073, G1067, G2156
tttttttttttttttttacatatataataataattaattgagaattaatcataatgataatccacatatagctaattgcgagctagaatggtggctgccttgtagtagtagcagcattattaccagtagtagtaccagtgctgctccaattgcctgcggcaaaaacgtcaccaccaccaccaccaccactaaatggataattaattcccatattcataattcccaaattatgaaaaggccaaggcacgccaccgtctcccaattgtccgccgccacctgtcactcctgaagactgagaggctgccggtggtggcgtagtggagtctgcatcctcctgaagctcaaggggtaacctatcgtagactgcatttgcaaaagaagcggccatcaaaaccacagtacctgaagcagtcaaagggcccaccacgctccctccgacaacttggccctgcccacctgctaaatatatagtcaagccaccagctccggggggtgccggaggtggaagtgaagttccagtgagtgacaaaatctcaaagcggccgtgaagtgttatgttgacagcaccaccagcgctactagcactgctgctgccaccagctccagctggtggttgcctgagtgtgacattagtaacagctccagttccgctgagaatacaaacaccacggccacgacgccttgcataggttgaaacggagtccacaatgtcagcgccagatgatatttcaaggacatgggatctaagtgcattaggggtgtctctagttacgattattggtggcttctgcttgttctttg

SEQ ID NO: 16666 - DNA, 855 bp, Citrus sinensis
  Predicted polypeptide sequence is orthologous to G1988
ggggaacaccaacaccgccttcatttcattttctctccttttatttctcctcaaatctctcttcctcaatcttttcctcacattctattgattctctaaaaccacaaagattcttacggcctccctttgatctctctcaacccaaaggcaaataacacatacgattttcttgatttatttgaatctcatctcgtgaaaatcaattataattttaaatattgtataatatgaaacgagcttgcgagctttgcagccaagaagcggccctccactgcgcttccgacgaagccttcctttgtttcgactgcgacgatagggttcataaggccaactttctcgtggctcgtcacgttcgtcaaactctgtgctctcagtgcaaatctttgaccggaaagttcatctccggtgaacgttcatcgtcatcgctggtacccatttgcccgtcttgttgttcttctactacttcgacgtcgtctgattgtatttcttcaactgaaagctccgctgcggagaaaatgggcagagaacgtaaaagggttcgtgcatgttcgagttctgtgtcggatatttccggcgaaaaggcggcggctgtgacggattccaaggcggagggtatttttgcgatttggtgtaggaggctggggctgaatggtaataatagtaattgtaattcggttgttgttgtctctttggcgagtcgggcgctggggttgtgtttggaaaggacgacggcgttgcccttacgggcttgcttggcggcgtcgttttggtttggtctgagaatgtgcggggacaaaacggtcgccacgtggccgaatccgagaaggcttgaggcgatatcaggagtgccggcga

SEQ ID NO: 16667 - DNA, 862 bp, Citrus sinensis
  Predicted polypeptide sequence is orthologous to G3
ggggggcaataaaagtggagtcgccttaattatttttgggttgggcatcggtatgtgtccctcagaactcacaacaagaagaaaactttgattaattatctacgaaaacgacatggaaggaggcgggtgctgcagcacttcgacttcaacgaaaagcccagagaagcggaagccaaggcagcagcggcaacaccaacagcagcaggaaaagccgtacaaggggataaggatgaggaagtggaggaagtgggtcgctgaaattagagagcctaacaagagatccagaatctggcttggttcttacaccacgcctatagccgccgcacgtgcctacgacacggccgtcttctatctccggggcccttccgctcgtcttaacttccccgaattgattttccaagaagacgatcttcgagacgtttctgccgcttcaatacgcaagaaagctaccgaagttggcgctaaggtcgacgctttacaagctgctctccatgctgctaattcagaatctgaatccaattccaattccaatttcaattctattcgattgtccgagaagcctgatttaaacaagtttccagagagttctgatgaagattgataacacaaaatacttgcaagctcacaattacctaccctagtctttccacgtttacgtactgttttattcccatcatcagtttcaactttgaaaacgtacggaatcacaaggattctgtttcatatatttatattatatataggtcgatcttcttaattagtatgtaacacgtacgactgttatttatttagttgattaattagttatggtcttaatttttgagttaactaaaaaaaaaaaaaaaaaaaaaaaaaaaaaaaa

SEQ ID NO: 16668 - DNA, 938 bp, Citrus sinensis
  Predicted polypeptide sequence is orthologous to G4
tttttttattaacaggattacatcatccggttcagtttttgatcacaaatcacacataatcatccatacagtcactagattgcaaaatgttcaaaatgcttcaagtctcataggttaaaaggaacctaaacacctatatactaagaatctactgaaagctcctgagagcaatctccacacatggcttggcttaagcatgtccaacaattaagcactgcatctccaacacagatagacaaccagtcctcaaagtaacatatagccttatttacaaaactagcaagcacattaaagtttgctcaatacactccccctagggtagaagggaagtcatcaaagctccaaaggttcatcaagtttccaccatcctgagtgttgtcaccattgaggaaggcatcgagggaggcctcccagcttccttcaggatacggcattggcaagaacttcacctgattgtcaaaagccaaaagctcatcagacagagactttccattgttatcctgaacaggcacagcattctcagagttagatttcagcttcttcatcgggtttgcaaccgcatccacaaactgagattcatcaacttcaggggtagcttccaaaacagatgagatttcaggagtctttggtgcctgttctccccagccaaagtcagaacaatcaaaggagttactgccttggtcagagttgaagtacaaaggagtatcatcagctgttggcacaaagggtttgaatcctagttctccatcattagggaaggagcccaaatatccatactgattcacttgtggtttctcctccagaatactcacattgttgtagtaatcctgatcggagttgttcaagtaatcgaagttctggttcaaacttggctgcacggggcttaggcaagctttgggaactgatttctgagagtttgccttcactgagctctttgg

SEQ ID NO: 16669 - DNA, 821 bp, Citrus sinensis
  Predicted polypeptide sequence is orthologous to G5, G974
tttttttttttttttttcgattacaaagagacacttattatattcgatacatagtctatggacacatacaaggaaagaaacacgaatttctcccaggttcagcatgactaaaaccagctgaccacggtggagatttacatccatattaacatactaataataagcttggcgctgcaaatgccaaaaactccattgcagccgccactaacaactaagtctctcctactaaaccctaaacccaactacaaattacaaattacaaacacgccttaaacaatgacttgtacttaagataatattgaagcccaatcaatctcataagatgggtacttctgcaacatgaaattctccgaagcagcatccaattcaagctcagaaggtggttcggtaagatcctgacacgtcaaatccgaaacgggagaagacccagctgacccatcactcaaactgcactcgttcttaacaccgacgcctgcacctccggctccctccacgacgtcaactttcttattcccggatcggtgtcgtttcttctgggcggagttactttgcttctctttcttactagtccccagtttctgcgtctcggccaagttctcacaaatggctgccaatttcgcatcaactgaagaatgaagaggcttgtactcgccgaactcgccaccgatgtgagacccattgtgacgtaggttagggaagttgagccgagcgaagtcgccacgtagcttgtaggccgccttatcgtaggccaacgcggcttcttcggccgtgtcaaaagtgccgagccagagccgagtccggttcttgggcaagcggatctc

SEQ ID NO: 16670 - DNA, 946 bp, Citrus sinensis
  Predicted polypeptide sequence is orthologous to G5, G974
tttttctgaagactttcagataagcacttcaacagtacaagcgctttgagagccacagaagtacacaacgtacaaaaggacccaacacaatcacatgctcaccacatccgtgctttgcacagaaatatatataatacataaatatattcaaaagctgaaattgtttacaaaatacaaccatgataacttcaacaagaagatcaaattccccatagtcacagcatggaagaaaaaaacaccagcctgaccaatccggagagatcacatagcacctggctagtaataacatcacatattaacatgactcttcttgaacttaaacctactaaattaagactaaatagcaactctgcaagtgtcaaaaatttcattgcagatgccactctttagactctcttaaaaaaaaagggaaaatacaaaccgacctagaaaatatagcaagactaaataattaaaactcagataattttctaatagcttcccaatcaatttccacagaagggtatttctccaagccaaaagcatccatttcagtttcccacttggtgtcattgaagtctaagaaagatatgtcagattctggtgatgatgagccagcatcagataatgaatgatctggtgttggtgatgataatgaagttgctgatgtgttctcaacctttatgttagcagcagtagctggtaacaacactggttttgtttcagcctcctgctgctgctgctgctgctgcttggatgtttgtttctgcacgttgttgttaagagccaagttttggcagatggcttgcaattttgcatcaacggaagcatgaagaggcttgtaatcaccaaattcaccagtgacatgagctccatgatgcttgaggtgcgggaaattgagtcttgcaaactctcctcttaggctataagcagcttggtcatagggcaaagctgcttcttcagctgt

SEQ ID NO: 16671 - DNA, 893 bp, Citrus sinensis
  Predicted polypeptide sequence is orthologous to G8
cagagttatattgattgtttagcaaatgagtcagaaaacaagtctttggtgtatatgaatcactatttgaatcatacaacgaatttgaagaccactgctgttattgttgcctatagacactcaacatcgcgggatgaaaataggctatggtggtgcctgcggcagtttcatctgataataaaactgagaggtgttgggggcagtagtattagttgaagtgaaacagagattgacgtctgacggattgagaggttttgatgagagaacggcagcggagggaggggcagccgaaaatgggaatcctgatgatgctgcactagataacagtgacgctggggtaccactgacctggccatgcatttgccatgcccagttaggaaggccttgtggaggacccaattcgattctcttctctgttgctttttcctcagtagtaagaagaccaggatatgcaccattccagaaaattggatgctctgacgtcctcataagtcctttggaagctgaatcccccacagctgcagtagtagagttctcggtccttgaagtccttccaccatgggcaccataagggccagaaagaaactgggaatgcccttcatttgccttgggaccactgccaaacgatgaagatatccccaagttcaaatcaagattatgatcaccaccttcattactgccctcagtaatcatctccccttcatatgtgcttggctcaaagttggtgactgcctccctgccattgcatttgatagctgccttgtcataagcccttgcagcttctacttcgctgtcgaatagcccaagataaatatactttttgccgaggaattgccccatacgtgcttcccaacggccgcatttgtgtagtgtcacccctctatattttgagc

SEQ ID NO: 16672 - DNA, 588 bp, Citrus sinensis
  Predicted polypeptide sequence is orthologous to G12, G24, G1277
ggggatggttagagaatattattaattctttcagtttcaaaggaggccagttccggaaaatagaaagggggttgagttgattgagccagccagcatgcagggcggacccgcggtggcggagactacggcggcgaggaagagatcgatggacaggccttataaggggattaggatgaggaagtggggaaagtgggtggctgagataagggagcccaacaagcgctccagaatctggctcggctcttactccacccctgtcgccgccgctcgagcttacgatacggccgtcttttatctccggggcccctccgccaggctcaacttccccgacctcctcagaggagaaggcgctgccgggtcgacgccatcgaatccgccctccacaacaccccggaccaagagattcctccgcctcataatgattccggatttttgaaccgggtcgatttgaataagttacccgacccggaggatttggatggcgccgactggcaaacaaactaaaattaaactagctctgctccgctccgctacactaagatagcgaaagaaacgagacgttttcccgaaagaaaaggaaaaaaaaaa

SEQ ID NO: 16673 - DNA, 894 bp, Citrus sinensis
  misc_feature (794)..(794): n is a, c, g, or t
  Predicted polypeptide sequence is orthologous to G19
aaaactttctcatcccaacacacaaattagaagagaagaaaaaataatatgtgtggcggtgcacttattgccgattatgatgaagtcaggccggtcaggcgcgagcgcaaattgacctccgaggatctctggtccgagtttggttccatttccgacctcttgggcttggactacaatggcaaatcccaccctaagcaacctctcaaagtgaaaaatgagaaggctgaagattcaagcaataaagctgctcgtactgagtggaaggagaagaagactcagcgagttcgcaagaacgtgtacagaggaatacggcagaggccgtggggaaaatgggcagctgaaattagagacccttacaagggcgtccgcgtttggctcggcactttcaacacagccgaagaagccgcaagagcttatgatgaagccgccaagcgtatccgcggcgacaaggccaagctcaacttcgctcagccgccgccgccaatagctccacccccggctaagaaacgctgcatgccatcccctgagttgactcagccgagatttgaaaccatcggaaccccaccggctccggcgccgtccccgtgggtggggtttgggtatcagaatgagttttatcaacccagggcagtagacgacgagtttgagctgagccagcaaatttcgcgcttggaatcgtttttgggattggagccattaatgagtcagccgagtggaaacgttgctggtgggtgtgactcggtggacttttggatgcttgatgacgtggcggcgactcagcagctgaacagcantcagttcttgtgttaggaaaaataataataaacgaattgagttgtggccgtgctgtgtgttcgtgtgggtctgtgttttgagttattgtgtttaatgctg

SEQ ID NO: 16674 - DNA, 863 bp, Citrus sinensis
  misc_feature (835)..(839): n is a, c, g, or t
  Predicted polypeptide sequence is orthologous to G43, G46, G1419
ggggccactcaagcttctccacttcctgtttactccaattgtacaactaatattttttgaaatggcagctggtcatcattatcaccaagatcatgaagctttaaccttagagcgcataagccagtacctcctcaatgacttaacaccgatggatagctatagcttcatctccaacctcccgcagcaaaaccctgcttccactgatgaagaaattttagtacaaaagacatcaagcactctaagtcaacgcaagccttcttctataaacgtcagaatacctcctccaactactagcatcttcaagttgaaagatgaagataaagatttcgaggttactgacgattacaaggaaaggcattacaggggagtgaggagacggccgtggggaaaatatgcagctgaaattcgtgacccgaataaaaaggggacccgggtttggcttggaacatttaatactgccgttgaagctgcgaaagcttatgacaacgctgcctttaagatgcgtggaagaaaagccatactgaattttcctcttgaaattggtgagatcagtttggactctgatgaagtgcagcaagttgattgtgggaaaaagaggaaatatgaggaaaacgaggagtttgagagaaaagtgaccgtgaagaaggaggaaacggtgagtggtggtgttggtcttggacctttgacgccgtcaagttggaccgggttttgggatgatggaaatgggatatttagtgtgccgccgttatctccttgctttggccagttgggcgtttgctaaatttggaaattttttatggcagaacagtctttgatgacgtggaagtgaaattannnnnttgttaaaataacttaaccagcga

SEQ ID NO: 16675 - DNA, 819 bp, Citrus sinensis
  misc_feature (11)..(13): n is a, c, g, or t
  misc_feature (33)..(35): n is a, c, g, or t
  Predicted polypeptide sequence is orthologous to G43, G46, G1419
gcggggagcannntcaaaactctttaatatttnnnagattcaaaaactctataagggacacagcttgcttagttgccatggctacaccaattgaaaaatcagcgctcgagtttatcgagcaacatttgttcggcgaaaattctcctattgcgggatttagttcgagtttgtcgagcgacacttgctcgcaatcgcaaacgtccagctctgcatcttcagatcgtagtttcttcaacgatgccgttttcttcgactatgaatccaaacctcaaatcattgatcttgttacaccgcaacccactaatacttgctctgaattgactaacgatttctttgaatttgacattagacctcaaatccaatcgcaaccgagcaattgtagctcggaattcgaacccaagcctaaaatatcaccaaattcatcctctcaatcgtctcgcaaaccgtcgctgaaaatctcagtgcctaagaaagccgaaggtcatcatttcaccaaccggaaaagcaaggccaaacctgagagttcggaagaaaagcattacagaggagttcgacggaggccgtggggaaagtacgcggccgagatccgagatcctacccggagaggcgtacgtgtctggctggggacatttgacacggccactgaagcagctagggcgtacgaccgtgccgctttccagctgcgcggctcgaaagcgatcctcaactttcctcttgaagccggcaagtgcgactcaaacgctgcggtggctagagagtgtgactcgagcgccgaggctggcgcttgtgaaacgaaacggaagagggactgtgagagcg

SEQ ID NO: 16676 - DNA, 857 bp, Citrus sinensis
  Predicted polypeptide sequence is orthologous to G43
ccccttttccgcccccactctttggtcttaagaatgctggttttaagaatgagtaattgcccttctccgacccttactgcccaacctgagagtggacagctaatgcattccacttattgagcagggttctatggtcggtccgcgacccctggataccgaaggcgtccttggggtgatctcgtagttcctacggggtggagacgatggggtcggtccatggattttccttccttttgtcgcatttcgctcaaagggttgaagggagatagtgcatcaagctgttcgcaagggccaacttgatcctcttccccagggatcccagatgagggaaccctaagagagccgccgactccaactaccgtccatgtacgatccatactagatctgaccaaccgcccatcctacctcttctacgttcttgacagcccatctttgtctcagtagagtctttcagtggcatgtttcggtcctcttccccattacttagaaaaagttagccaccggttcaggtacaagatactatcattaccgcctggacaattagacatccaacccgtaatcgcaacgacccaattgcaagagcggagctctaccaactgagctatatccccccgagccaagtggagcatgcatgaaggagtccgacgcttcttctattctttttcttttccttggcgcagctgggccatcctggatttgaaccagagacctcgcccgtgaagtaaatcatcgcacctacggtccaaccaattgggagagaatcaacggattccttttcgggagcgattcatccttcccgaacgcagcatacaactctccgttgtactgcgctctccaagtgtgctttgtccccccct

SEQ ID NO: 16677 - DNA, 686 bp, Citrus sinensis
  Predicted polypeptide sequence is orthologous to G44
ggggaaaatacaccaaaccaatttccatttacatttcatctcatcttcaataccaactgtagcttttcttttaaatatggcatctctgaatgaagcatcaactttagaactcatcagccagtatcttctcgctgatcagtactttacttcttcaattgatcatacccatagcttcaaaaatatctcaaaccttcctcaaagcccgagcttattcaacaacccaacaacaactacaacagcaacaacagttactactacaactgatcgtgataatataaacagcagaaacaagccttcaagcactttaaaacaacggaagccggcctgtgtaaaaaacgtaaccataccccaaactacaagcttcaatttgatgagctgctccaatgttaatgatgatgctgataacccagttgctgtgaaaaataaagatccagatgctgctgctgataataatactaataataataataaaaataatgaggaaaagcattacagaggagtaaggagacggccgtggggcaggtatgcagctgaaatccgggacccgaatagaaaagggagccgggtttggcttgggacttttgaaactgccgtggaagccgccaaagcttatgacaacgctgcgtttaggctgcgtggaagcaaagcgatattgaatttccctctcgaagttggcgggactttgg

SEQ ID NO: 16678 - DNA, 804 bp, Citrus sinensis
  Predicted polypeptide sequence is orthologous to G129, G136, G140, G146
gggggatatttttttcttttttcttttttgtctttttcaggtgtagctcaagcaagttaccagcaaccatggagtttccaaaacaaaacccagaaagctcaagccaaagcaagaaaataggaagaggcaaaattgagataaagcggatcgagaacacaacaaacagacaagtcaccttctgtaaacgccgcaatggattgttgaagaaagcttatgaactgtctgtcttgtgtgatgctgaagttgctctcatcgtcttctctagccgtggccgcctctatgaatatgctaacaacagtgtcagagcaacaattgacaggtacaagaaagcatgtgccgattcttctaacccaggatctattactgaagctaacactcagttttaccagcaagaagccacaaaactacgaagacaaatccgggagattcagaatttgaacaggcacattctgggtgaggccctcagcactttaaactttaaggagctcaagaaccttgaggcaagacttgagaagggaatcggcagagtcagatccaagaagaacgaaatgttattagctgaaatcgagttcatggagaagagggaaattcagcttcaaaatgataacatgtacctgagagcaaggatatctgaaaatgagagagcacaacaagaacggcaatcagaaagcatgatgcagcaaggaggagggcatgtgtacgagcccgcggcctcacagccctatgaccgaaacttccttcctgtaaacctcttggaacccaatcaccagtacgctcgccaagacgatcagccccctcttcaac

SEQ ID NO: 16679 - DNA, 847 bp, Citrus sinensis
  Predicted polypeptide sequence is orthologous to G129, G136, G140, G146
tttttttttttttttactaatcattaatatcatattcgaaattaacatcaaatgcagagactttgtgtttgcattaggcatacagaatatgaattcatggctgacaaacatatatataatatttatgagtcttaaaatagtttatatagctactagcttaggcccctgatgatcacttaattaagcaaagttgatttcttcgctgcatcttatagcaattttgagcgcgcacctgcacaccttttatctagaatgaagtaatagctagataccctccataggatatgacatggcagaatattcttcaaacatattaaactaactgaagggccatctgatcctggcgtgggtaatgattggtgggctgtaatgcattgacttggaaatagctccgggaatcaaatggctgagactgtataatctcgtagctactccctccttgcatcaaattcatgttctgctgtcctctttcattctcggctatctttgctcggagaagctggttgctgttgtgcaagtcaacttccctcttctgcatgtactcaatttctgcaaacagcagctcattctttttagatcggattctgctaatacctttctctaaacgagtctccatgttcttgagttccttgaaatttaacccacttagtgattcacccaacatgtttctgtttgaattttgcatattgctaatttgtatcctcagcttggcagcttcttgctggtagaactgagcatttgcttcacagatagacccagtatttgaggtatctgcagtggccttcttgtacctgtcaattgttgatttcacactgttgttggaatactcataaaggcggccgcggct

SEQ ID NO: 16680 - DNA, 933 bp, Citrus sinensis
  Predicted polypeptide sequence is orthologous to G129, G136, G140, G146
ctttggttttctatttttcttcgggattctaaattttccgaaagctgaattggccggactgtggccaaaaaactcaggtccaatggggagaggaaagattgagatcaaaaggatcgaaaacacaacgaatcgtcaagtgaccttctgcaagaggagaaatggactcttgaagaaagcttatgaactttctgttctttgtgatgctgaagttgccctcattgtcttctccagccgcggccgcctctacgagtactccaacagcaacagcataaggtcaacaattgataggtacaagaaggcatgttcagataattcaaattccggcactgttactgagatcaatgctcagtactatcagcaggagtcagcaaagctgcggcagcaaattcaaatgttacagaattctaacaggcatttgatgggtgattctctgagttctttaactgtaaaagagcttaagcaactggagaacaggcttgagcgaggcatcactaggatcaggtccaagaagcatgaaatgctgctagctgaaattgagttcttgcagaaaagggagattgagctggaaaatgaaagtgtgtgtctccgatcaaagatagcagaaatggagaggtttcagcaagcaaacatggtgactgggcaagagctgaatgcaatccacgcattagcttcacggaatttcttcagccctgctatcatcgagggtggtgtcactgcttactctcacccggacaagaagatactccatctcgggtaagctagatactggagatcaagttgtggcatctcaacaaaagatctacgatcaaactatcattatctactgaatgtgtgtgctacttgatactatttttgaaaccagcgatatatgaaactggatgaatttgtctgtaacctaattacttacgctgaattatcactggcttcctctct

SEQ ID NO: 16681 - DNA, 872 bp, Citrus sinensis
  Predicted polypeptide sequence is orthologous to G131, G135, G155
gggatagcaaaagttctgcagcacactactcactacctgctctaatctctttttctataaaagtacagagattagagagatacccagaagaagcctgcaagtttctttagtggagaattgctggtgataattattaatagatagttaatatggggagaggaagggtgcagctgaagaggatagagaacaagatcaatagacaagtgactttctctaagagaaggtctggtttattgaaaaaagcccatgagatctctgtgctttgtgacgctgaagttgctttgatcgtcttctccactaaaggcaagctctttgaatactctactgattcatgcatggaaagaatccttgaacgatatgagaggtattgttatgcggagaggcagcttcaagcaaatgagattgaaccaaatggaaactggacattggaatattccaagcttaaagctaggatggaggttttacaaagaaatcaaaagcatttcatgggagaggatcttgcagacttaagtctcaaagagcttcaaagtgtagagcagcagattgattctggtcttaaactcattcgatcaagaaagaaccaactcatgcttcaatccatttcagagcttcagaaaaaggacaagttattgaaagagcaaaacaacttgcttgcaaagaaggtaaaagaaaaggagaagctactgagccaagaggcgcagtgcagggaacagcagcagcagctaaatcatgactggaactcatccaatgttcatctaatgcagacattgaccaatagctcttaccaaatgggagggggcagcggagaggaggatgaggatactctgacaggacatcgagctaacgctctgctgcctgcttggatgcttcgt

SEQ ID NO: 16682 - DNA, 766 bp, Citrus sinensis
  Predicted polypeptide sequence is orthologous to G131, G135, G155
gatcatacacaagaattcataacaatgggaagaggtagggttcagctgaagagaatagagaacaagatcaatcgccaagttaccttttccaaacggagagctggcttcttgaagaaagctcatgagatctctgtgttatgtgatgctgaagttgctgttattatcttctctcacaaagggaagctctttgaatactccactggctcttgcatggaaaagatactggaacgctatgagaggtacgcctatgctgagagacagctgattgcccctgatcctgaatcacagcgtaactggcccctggagtgcaacaaccttaaggctaagatagatcttctgcagaaagaccaaaggcactatttgggagaagatttagagtctctgtccctcaaagacatccaacagttggagcaacagctggacaccgctctcaaacacatcagatcaagaaaaaatcaacttatgcaagagtccatctctgagcttcagaaaaaagaaaagtctatagaggagcaaaacaacttgctggtaaagcagattaaggagagagagaaggctgcagcgcaacaagctcagtgggggaatcaaattcaaaaccaggttcccaacacattatcctttctacttccacagccacctccttgcttaagacttggcggtgcctaccaggaacaggcatcggagatgaggaggaacgagcttaacctcacccttgaacccgtatgttcgtgtagccttggatgctttgctggatgaactgtgagag

SEQ ID NO: 16683 - DNA, 816 bp, Citrus sinensis
  Predicted polypeptide sequence is orthologous to G133
ggggggggaaaatgggtagaggaaagatggagatgaagaggattgagaacgcaacgaacaggcaggtgacattctcaaagagacgaaatgggcttttcaagaaagctcgtgaactcaccattctctgtgatgccaaggtttccattctcatctgttcaagcactgctaaggcccatgaatacatcagcccttccactacaacaaagcaattgcttgatttgtatcagaagactttaagaatcgatctttggagctctcattatgagaaaatgctagagaatctgggggctgtggaacaagtgaataggattctgaagaagcaaattaggcagaggatgggtgaaagcttgaacgatctgaccttggaggaattgactggtcttgagcaagatatccttgatggtttaaagattattcatgaatgcaaggatcaggtgctcgcgagacagattaatactttcaagagaaaggtaaggggtgtgcaaaaagagaacaaaagtcttcaggatggatttatcattaatgctaaagaggaggatccgcactatgagtatgagttagttgataacggtgagcattgtgattctgattttggattccaaaatgaaggtcctggcatatttgctttacgcttgcagcctaactaagcctaaagtacccagtggacgaagactgagtagcatgtgagatgacttagcattatcaatacattaagttaccaacacactataagtatgagaatttgatgaagtgttttaaatatggtaagaatcaccttgttttagcaaaaaaaaaaaaaaaaaaaaaaaaaaaaaa

SEQ ID NO: 16684 - DNA, 664 bp, Citrus sinensis
  misc_feature (32)..(32): n is a, c, g, or t
  misc_feature (34)..(34): n is a, c, g, or t
  misc_feature (59)..(59): n is a, c, g, or t
  misc_feature (61)..(61): n is a, c, g, or t
  misc_feature (67)..(67): n is a, c, g, or t
  misc_feature (84)..(84): n is a, c, g, or t
  misc_feature (107)..(107): n is a, c, g, or t
  misc_feature (146)..(146): n is a, c, g, or t
  misc_feature (167)..(167): n is a, c, g, or t
  misc_feature (171)..(171): n is a, c, g, or t
  misc_feature (175)..(175): n is a, c, g, or t
  misc_feature (186)..(186): n is a, c, g, or t
  misc_feature (196)..(196): n is a, c, g, or t
  misc_feature (206)..(206): n is a, c, g, or t
  misc_feature (210)..(210): n is a, c, g, or t
  misc_feature (287)..(287): n is a, c, g, or t
  misc_feature (325)..(325): n is a, c, g, or t
  misc_feature (327)..(327): n is a, c, g, or t
  misc_feature (335)..(335): n is a, c, g, or t
  misc_feature (579)..(579): n is a, c, g, or t
  Predicted polypeptide sequence is orthologous to G133
gtttttttttttttttttttttttttttggcncnaaaggaagggtataaattaagaacncnagaccngtgtaattaaaacatcncccttggaaactgatgataaaanaaaatgacactatctttcaaacagttcatctaattcccncatactactcgtggatactcntccnctgngaacttaaggnttcgttaggntgcaagcgcnaggnaaatatgccaggacctccattctggaatctgataacagaatcataatgcccctcattatcaactaactcataggggngatcttcctcttttgcattaatgataaatccattccgnanttttctgntctcctcttcctctcttcttacctttttcctgggggtaacaatctgacccgatatcgctcgaagcttgcgttcacggataatcctcaagcaattatccacatcttgctcaagatcagacaatttcttcaagctcagatcattcaaactttcacccaacctttgcctaatttccttcttcagatttatattcacttctttcagattcttcagattcttttgcattttctcatattgagaactccnaagatcgatctttaatctcctctgatactcatcaagcaactgctttgttgtagtggaggagctaacgtattcctgggacctttcc

SEQ ID NO: 16685 - DNA, 838 bp, Citrus sinensis
  Predicted polypeptide sequence is orthologous to G133
tgcaactgaaaatccaattaagctcttagctcttatcatttttgttcggtaatactactgtgaatagctatagctcggtgaattattctgaaatatgggtaggggaaagatcgagatcaagagaattgaaaaccctaccaacagacaagtcacttactctaagcggagaaatggtattttcaagaaagcacaagaactcactgttctttgtgatgctaaggtttctctcatcatgttctctaacactggcaaatttcacgagtacataagccctacaaccacgactaagaagatgttcgatcaataccagaagagtttaggggttgatctctggagcacccactacgcgaaaatgcaagagtcgtacaggaaactgaaggagatcaataataagctaaggaaagacatcaggcagaggatgggagaggatttggatgatctaacctttgaagaactgcgtggtcttgagcaaaacatgtcttcttctgcggctaccgttcgtgaaagaaagtttcatgtgatcaaaacgcagacagatacctacaagaagaaggtaagaaacttggaggaaaggcatggaaacatcctgctggactttgaaacaaaatatgacgatccacattacggattagttgacaatggagactatcaatccgcaatggcattagcaaatggagcgtccaacctgtatgcatttcgcatgcaacagcaaaaccttcaccaggggactggggggtatggatccagtgatcttacccttgcctgattgcatttgagaggttaattacatcgaccgatctcttcaggtttcaaaattaattctaaatgtgtgctatca

SEQ ID NO: 16686 - DNA, 717 bp, Citrus sinensis
  Predicted polypeptide sequence is orthologous to G137, G145
ttttttttttttttaaaaaaaaaagggggaaagaaagaaagtgtagctaggtgagaggaaaatagaggatatgggaagagggagggttgagttgaagagaatagagaacaagataaacaggcaagtgacgtttgctaagagaagaaatgggttgttgaagaaagcttatgagctttctgttctctgtgatgctgaggtggctctcatcatcttctctaatcgtggcaagctctacgagttttgtagcagctctagcatgctcaagacccttgaaaggtaccagaaatgcagctacggtgcagtggaagtcaataagccagcaaaggagctcgagagcagctaccgggagtacttgaaactgaaaacaggatttgagtccgtgcagcgaactcagaggaatcttcttggagaggatttggggcctctcaactcaaaggaactggagcagcttgagcgtcagctagagtcatccttgaagcatgttcgctccaccaagacacagtatatgcttgatcagctttctgatcttcaaaacaaggaacaattgttactagatactaacagagctttgacaataaagttggatgaaatcaatgcaaagactcagcttcgaccttcttgggaaggcggtgagcagcaactaggttataatcctcagcatgctcaaactcaaggactattccagcctattgaatgcaatcctactttgcaaattgg

SEQ ID NO: 16687 - DNA, 935 bp, Citrus sinensis
  Predicted polypeptide sequence is orthologous to G137, G145
ggggggtatctgatgaaaccaaaccaattagcaaaattaaaggtacccaactcaggtcaagtcaattcgatctctccttttaggagtgttctatactaaatcttaaacctagctatcaaagcaacctgatcccagcttcttgccctaaacaacaagatctgcagaaacaaaatctactaatttataatttattttttagcctaaagaaacccaaaaaaaacaaaaaatcatccagctatccagcacttgtaagtatattaataatgggaaggggaaagtagagctgaagaggatagagaacaaaataaatcgacaggtgacttttgcaaagagaaggaatggattgttaaagaaagcttatgagctctcagttttgtgtgatgctgaggttgctcttatcatcttctctagccgcgggaagctctatgaattctgcagcagccctagtatgcacaagacacttgagaagtatgaaaggtgtagttatggaacactgcaagcaaatcatcaatcagccaaagagacgcagcaggccagctacgaggaatacataaaactcaaagagaaacatgaggccctacagcacttgcaaagacaattttttggggaagatttgggacgcttaggcttagaggagttggagcagcttgagagatagctgggcagttcattgggccaagtaaggtcactcaagacccggaatcagctggataagctttctgaacttcaaaggaaggaagaaatgttgctggaagccaataacattttaagtatgaagttggaggaaattaatgcagctcggagatcacatccatgggcagctgaggaacaaaacattacatacagcaaccaacctgctcattcggagggttcttttggccatttacacagcaatggtacattgcacttcggtcacaatcctggagtaacagctc

SEQ ID NO: 16688 - DNA, 859 bp, Citrus sinensis
  Predicted polypeptide sequence is orthologous to G137, G145
cttatcattttctctaaccgtggcaagctctatgagttctgtagcagccctagcattatgaaaacgcttgaacgatatcatcggtgcagttttggtgcacacgaagccaaccggcctcccattgaaactcagagcacctaccaggaatatttgaggttgaaaacagcagttgagctcctacagcgatctcagaggaaccttcttggagaagatttggatccgctcagcacaaaggagcttgagcagcttgagcatcaactagagacatccttgaagcatgttaggtcaacaaagactcaatgtatggttgatcagctttccgatcttcaaaaaagagaacaagtgctacttgaacttaacaaaggcctgaggaagaagttggacgaaagcaatattgctcatcaagttcctcctcatcgactagcatgggaagcagcatcagcagggcaaaacataacatacaatcgctacccagttcaatcagaagggttctttcagcctctatcgggaggcaatcccattttgcaaattgggtacaatcctatgggttcggaggaggcacatattccagtccatgcacaaaatgtcaccggattcatccctggttggatgctttgattataattggataataaaatgagttcacatgagcttaatcattggaattctaattaatttccttgttgatggttgtgatttgatctgttttgctttatgtaacctgcaattattatttgctgcaaacagtaataagtattgtttgtaagttgtaacttgtaatgtttgaaaatgacggaatgctcttttgttgttgtatggcttgtatttatatgaacaactgctatctcgaacaaaaaaa

SEQ ID NO: 16689 - DNA, 878 bp, Citrus sinensis
  Predicted polypeptide sequence is orthologous to G142, G148
tatacgacaagtatgtagagtatcttggcaaaatattacaaaccccagttagtacaaaagccattagaaaaaattatataatcatcacgtatgcttaattacatatatctcaatgctctactcaaaggacccatccttggatgaagttggtctcaccaaccgtattctttggcactgaagacccttcagatggaagataattcaggtacccaatttgtagagcaggttccgggtcacagttcatgggactgtcatgagaaggatgaacagagaagttgctatttccagcacctgcagcagcagaattccacaggtcttgaatggccttaaaactttgcccttcagtctccagcttaatcctgagctgcttgttgatatctccaagctgacgctcctttttgcggaggtcttccacctgctctatcataatctgtgtcttcctttgcctggccagtgctagggctccttcaagctgtttctcaagattctgcagctcctttacactcagcggtccaagatcctctccaagcaaatgcctttgagtgcgttgaagagactcatattttgctttcaactttgttgcctcctggtaccagctctgtgtttcacgttcgatgctgttgtcttgaggattgaagcagcaacgttggtatcgctcaagggttttgtttatgccagcactaccaaactcatagagcttgccacggctagagaagatgataagagcaacttcagcatcacaaagcacagaaagctcataagctttcttcagcaaaccatttcttctctttgagaaagtgacctgtctgttaatcttgttctctatcctcttcagctccactcttcctctccccataatttttcagtacactcacttt

SEQ ID NO: 16690 - DNA, 917 bp, Citrus sinensis
  Predicted polypeptide sequence is orthologous to G156
cgaattggggtaccgcggccccccctttttttctaaaaggagtttaattaaaacttcgtttcgcaaacgtgcagttacaaagaacacccatttcaataagcatacttaaactaacaagtttagagttcgaacaaacaaacacaatagcatatgtatatatatttataagctatatgtaagagtccctttatatattttgtcgtggcactattgtttcttcttcctgatcccagaagcactttccacagacctaatcacccaaaggtggggaaatgaagaccgaaatcttgaagattaggctgagtaggctgcagtcggaagggctgataatgaggaattgcaagctcaagaacactgctgggttgtgcctctccagaaaatggaaactgatccagcacttgtccatgttcttcaaactttgataccattgctgcctgctgctgctgctgctgctcccatgccatctgattgttattatccttaagcaggctgaatatttgctcattctcctcctccaacattttctccttcctaagaagattgtctgtctgctgccgtaagatctccatcttcctagctcgaaccttcttgactgaacactccagttgatgttcaagttgagtcaactcctcaagtttcacagagttcaagtcaatatcacccgtgtagcgtcggagactcaattcaagattgtgagtttctttcctcattcttcctaactcattgtaaattgcttccgaatcctgattgttaacgccggctggaattctcacccctttagcagcctggtaccttcttatgatttcttcaatgctggttgattcactgcagaattcggtcagttttccagtgcatgagaagatgatgaggcctatttcagcatcacacagcacagagagctcacgagccttcttcaa

SEQ ID NO: 16691 - DNA, 902 bp, Citrus sinensis
  Predicted polypeptide sequence is orthologous to G157, G859, G1759, G1842, G1843, G1844
tttttttcatctaacctcctgccagtttgtgcagttttttaaggccattatttataaattgttgtctcatatgttgttgcatttctgctcaagcatggttacacaaatcacaaaataataaaacattctgcaagtttgatgatggcagatgataaaaacgcagtcagtgggaacttctacagaagccgctccctgattatctagccgccttatagtagtacagagcattacaatttattcgctacgtagaattagccactgataacagtcttacatattcaccaagtacaacagatgggcggctgaaaagtacacttggaaaagcgcctctcctcagcttatctaagcaaagggagggttgccatagacgctgctgttgtatcattaccactcttctcccctgctgcaatctttccctctagaagctttttctcttctctcagcagcttttccttctcttggagtgttctaatggatcccatcatcagttgtgtcttcacagctctaatttctgtcagtgtattgttgagtagattctctaactgcagaagatcagctgcagtgaactgctcaaagtttggaccttcaagttgcctttgaactattttcagcagttgcaggctcgaatatccagcctgagggtcctctgccttaggtgctcctgaagctacagcttcctctgtaatgcgactctggtagcgctcaaggatgctggccaaactgtcggcgctacagaactcgtaaagcctaccgcggctggagaagatgacgagcgccaagtcgacgtcgcagaggacggagagctcacgagccttcttgatcaatccgctacgccgctttgagaacgttacttgacatcggcttttgttttcgattcgctgcagttgaagctttttccggcc

SEQ ID NO: 16692 - DNA, 441 bp, Citrus sinensis
  Predicted polypeptide sequence is orthologous to G175, G877
cagcttcacaacagcatggcaagatttgacagacctgcttcttttggttctttcagagtacctggaaggcagcagttcggaccttcccctggcttctcatttggaatgcatcaaccaggcctggccaatctatctatggcaggacttggccccggccaacctgagctgcctgttttgcctgttcatccatatttggcacagcaacgccaggttaatgaaatgggtttcatgatgccaaaaggagaaccaaaggtggagccaatgtcggaacctggtctgaacttgtcgaatcgttcagcagtttaccagcagctgatgagtaggctacctcttggacctcagatgtaaatgttgctgctttattttatttgaatttattccataattataattataattataataataattattattgttttgttgttcaaaaaaaaaaaa

SEQ ID NO: 16693 - DNA, 613 bp, Citrus sinensis
  Predicted polypeptide sequence is orthologous to G179
tttttttttttttttttttttttttagcaaggaacacattattaatcattataaagttaagaaattagtcactccaactcccaccaccaccaaatataataataacaacattaaaaaatgtgactaaaaagtacaatcctgaaaaaataacatatacttccagttgcatcattacatagcataacaacatagcatcgatactcctgcttcccgccacttagcagcaattgttattcggcatccaacttccaagtaaaaacctgaattatgaacagcagactgtcctctgttcgttcaatgcaaaacatcctctcataatagtctcttcaatctatacttgtacatatcccttttcttcaatccttttactttttcctctctctctttttttttttttttctcccttttttgatcttttagacccaaagtaatgtatcgaccagacaaaagctaaggttcacttgatttaacaagaccacaaaacagcgacagcagcactgcagcagtaatgagtttccctgcttgacatctttacactagatcaatggttgtctttactatttgcacatattatcccgaaggaaatcatgcatatcacggctactagccacac

SEQ ID NO: 16694 - DNA, 746 bp, Citrus sinensis
  Predicted polypeptide sequence is orthologous to G184, G186, G916
aggatactggacaaacacaacgtcattaacccaactctctctctctctctcgattcgttccactttctcttctaaatcttcccttcttttgcttttgcttttgcttaattaactttcttcaatttaattatatttatggacaaaggatggggtctcacacttgattctgatcatcctattgttagtaatctgaatttcttcacaagcaacaagccaaagccatcattagcaaggtttagaacaaaccgtgacatggctgcttctggtgctgctgactcatcttctgtcagaatgtttcagcttccggcctccgacaatagtaatgctccctcctcgtctgatgataatcgggtggctgttgatgaagttgacttcttttccgatgacaagaacagggtttctatctctgatcatcgtgaagatgatcgtaacaagacaacaaattctgttcacatcaagaaagagaattctcacgaccaacttcgtcacagaactggcttggatgttaatactggcttgcatctacttactgccgctaacactggaagcgatcaatcaacggttgatgatggggtttcatctgatcatgcggacgaaaaacgaacaaaaattgagttgactcaattgcaagtggagctgcaacaaatgaatacagaaaatcaaaggttaagagacatgcttagccaagtaactaacaattacaatgcactacagatgcatattattgcattaatgcaacagcagca

SEQ ID NO: 16695 - DNA, 760 bp, Citrus sinensis
  Predicted polypeptide sequence is orthologous to G184, G186, G916
ttttttttttttttttaatattgaacatagtttgcatcccctaaaaataaaagaactaataacatgaaaacattgattaaaagtgaaaaagaaagagctggcccatctctaatttgatgagaagctgtaaagtttattggtgttgcctgttgttattattggagttgttgctaaaaggattttgtgcaccgccaataatggaagtgatggcggcggcaagagctgcagtgaagtttggatcagctgtgatggcggccgtggcggcacttacagtgtcagccaactgctgcggttgttgcaatggtggaggtagagtttgatggctacccgattgagaattagacccaatattttgagataattgtagacctgagaattttgattgattgtaaagggcctgaccaaaaacttgaggcaattgagtgtttgtgacagaggcaagattttgtggctggcctggaaattggacttggaattgagctgcttgcctttggagttgtaaagggtttggtgaatgagtaaggtctaatgtaactgtaggaaatggggcagaagctgaaatcgtagccatgcttgatgagcaaggaagaatagctctggctagcaaattggggttcattatcccatctgcactcgacattgatcctgaaagtaacatgctagcagcagctgttgttgttgatgccattgccattgcagcaggaggtaaaggatgattgtgattgccttcataagttgttatcaaaatcgtcctatcttc

SEQ ID NO: 16696 - DNA, 873 bp, Citrus sinensis
  Predicted polypeptide sequence is orthologous to G194
caaaaacccatttcacaatgacattcataaagggtatgcgggaaaagactttctgcaagaaagatcagatcctgtcaactagtagattacataacatttacatctaaaccttttacggaagtcagttaaatagaaaaaaaaaaaactaataataattaaattgataatcaatatactcatcttccttcatctctactcttcccttagcatatgtgaaggaacaatgtcctgaagaaggccatgatccttaagcagatcagtccctgctgcaggagtgcagaaacgcctctcatgaagaaaagaagcagttgttggaccgttgataaaactactcccaaaattcataggcaacaaggaattaaccaagctgggcagttgttgctgagagaatgccgccggcattggcataccaaaagaggatccaacgacaccgtttccagcatgaggaacaccgccaagggttggacgtggtaggagtggactcgggtggttgtgctggccctcgtaggtcgtcacgacaatgcttggatcagtgtaagatctctccactcttttcttcacattacatgaagcactggtgcaacgatagtaactcctaggaaaggggctgtccttaacggccttctgaccgtacttcctccatcggtatccatcttccagatgatcaacctcgctctttgtcatgaacgcgaatctcggctctctctgtcgtttctgatttgtcttcttgggcttcaactgtttcttggttttttgttgattttgttcatcatgtacatgctcttctactttaacttgttcatcattcaaagcctcactcgatgcagatgaaatcgaggaagagttaggcgtcgccggctgattcaacaactc

SEQ ID NO: 16697 - DNA, 864 bp, Citrus sinensis
  Predicted polypeptide sequence is orthologous to G206
gggtcacattgtattcgtgctttgagatcaaacaatttgatcagagagaattaaaaagatacatagcaaagttaaatatactgcggtggtccaaaaatggtgagagctccatgctgcgagaagatgggattgaagaaaggtccatggactcctgaagaagatcaaattttaatcaattacgttaaactttatggccatggcaactggcgggcacttcccaaacaagcaggtttattaagatgtggaaagagttgccggctccggtggataaattacttgcggccggatattaaacggggaaatttcaccagagaagaagaggacactatcatcaacctacatgaaatgctcggaaatagatggtcagcaatcgcagcaagactaccgggaagaacggacaacgaaattaaaaatgtttggcacacccacttgaaaaagcgtctcaagcaaaagcaacaacaagagcccgtgattaataatcatagtaacgctaatcatgttacggcgagatccgagatctgcagcggcgccagtactcccgatcggcagactcgactactacttcaagcgacatgtcgtccgtcacctcctccgcggctaataacgcttgcgtgaaaacagagccgtcgtcgtccgaaaacaatcacgacagcttggttgaaatagatgagaatttttggacggaagtgttgtcggctgagaactcgggcattagtattgaggacagcaatgatcgtttttcagcggttggaagcgccgacccactgtctatagttgaatttcaatcatcactcgatgattttagaccaggttctactttgtgtgataacaccgacttttggttcaatcttttcaccaaagctg

SEQ ID NO: 16698 - DNA, 864 bp, Citrus sinensis
  Predicted polypeptide sequence is orthologous to G207, G227, G230, G242
tttttttttttttttttactcactaaccagtcctttgcatggcaacattccttaaaaccccatcaccgcccccaccactaccgttataacacgcgccacctctctgctgctcaagcgccgccatgtacgtcctcacttcctgctttatcatctcctgcatcacagccataaactctttactaaaccccactaatcccttcgacccactgtcactacttactggagccggcaccgaagcttttgcgttcactgcctgagttgactcactcactttgtttgaaacttctgaggaggaatccacaccaggaagggacagactcaatgaagtaggagggtcattagacgacgacgtcgtttccggctcgggcaccacattcacgtccacattgataccgccagatctcgccacgggtttgtatatattgtaattcgatgacaaacccggcacgcttgaatcgctgacgtcggatcccgatggactaccggggctcatataaagtcccgtggtcacgggcacactcgatcccgcactcaccgatcttttcaatttcaacggctgttgctgaatactattcccaaaatccgcatcgtatccattacaattcaaaaaaataccgttctctgtcaacatcgaagagcacttacgttttaaggtcgagttccagtgattcttaatcgcgttatcggttcggccgttgagaaggcgcgcgatggtggcccacttgttgccaaaccgagcgtgggctcgtatgatcatctcgtcttcttcgggcgtgaacgctcggtgctcgacttgaggtgacagctggttgcaccaccgtagccggcaagactttcccgatcttccgggaattgatttgctga

SEQ ID NO: 16699 - DNA, 843 bp, Citrus sinensis
  Predicted polypeptide sequence is orthologous to G207, G227, G230, G242
ttttttttttttttttgatttaaaaatgaaatttgtttattatcgtcgcgtaatgaacaaaaccctctcatcttcattcacgattcttctaatccatcctctctctgtacactaacaaaagtcattattaactgtttgtataataaaaagatctgattttttttcacatttgtttgtccggcgtcttctcataggtcgagtctaatttgataatcctatctgattcactaaatactctctaatcagccttgttaatcccgatacgcttaaccacagcgtttcttatggcttcagcaggcaaacagagcccgttacgttcaaccccagacatgtagtttctcacttctttccttatcatctcctgcatcactgccaaaaactccgggttgaaaaactgcttctcatatccaaactcgccctggttctgtgcctgtgcctgcacctgcaaaggttgtgttgatgccacctggttcgggttcaaaaccaagttggatccattttcggacccgggaccatgatttgagacctcacaagattcggatccgggcagcgagagactgagtgaggttggtggatccgttgttgaagatgaggtttcgacgggaacaagcgaaccggttcgaaacaaggggtggcaaactggagactgagccacaccgggtaagcttgaatcactcgaatcggatccagatggactacccgggttcaaacacaacccggaaatattattgctcggccccacactgttcgctcttttcaacggcagcgggttaatcgcatctacctgcgactcatcactcatggaagagcatttcctcttcaaagtggagttccagtggtttt

SEQ ID NO: 16700 - DNA, 352 bp, Citrus sinensis
  Predicted polypeptide sequence is orthologous to G207, G227, G230, G242
tttttgtctgtgatgcaagagatgattagaaacgaagtgagaaattatatggaggtggcggtgaggaacgctgggtttaagcgaacagggattaacaagattgattaagaaaattaaggaacgaaaattaaattttcgttgggataattctagactttggtaggagatttagaaattagttaaaaagatccaaaaaaaaaaagaatttgaggcttgtatagaatcagctaatgagagagagttcattttggagtagttattttgttagtgaaataatcaaaattttcccttgtggctaattttctggcttttgaaaatttcagttggaaatttggaaaaaaaaaaaaaaaaa

SEQ ID NO: 16701 - DNA, 866 bp, Citrus sinensis
  misc_feature (835)..(835): n is a, c, g, or t
  misc_feature (866)..(866): n is a, c, g, or t
  Predicted polypeptide sequence is orthologous to G214, G680
gggctataggtcaagcaattgacatagacattcctcctccacgtcctaaaaggaaaccacgcaatccttatcctcgaaagacctgcacaaatgcacctatgtcacagataggagcaaaggatgggaaacttcgaagttcagtttcttctttgcgttgcaatcaagtgctggacttggagaaagaaccaatttctgataggcctaatggtgatgagaagccaacttatactatcgaaagtcagaaggacaactgctcggaagtgtttatactgcaccaagaagctcaccgttcctctgtttcttctgtgaataaaaactccatgccaacaccagtggggctcagagactcttgcaatctcagggaatttgttccatcactgaaagaagtggtaaatcaggatgaaacacgtgaatcttatgtcactgttgaacttaaagcaaatgagaagtttggtaaacctgatgccaaactggcacttcaggataatggctcaagtaaacccttgaacttggagaatgcctgcccttcacatgagaagtcagttcatggtgaaaaaagagatgatgtggccgatgcattgccgacagctgaggtgcaagctacgcagaactatccaaggcacgtaaatgtgcacattctagatgggagccttggaacaggtactcaaagcccttcagatatgcctatgcaggagtccatatttcatcctataggagaagttcatggaaatcctaatctgttcacaaatccagctgcgtctgctactactgaaaatgagagtaatgtgccaaaatctactcatcaatcatttccaactttccatccctcctttancccatttcgccatgatcaagatgactatcgn

SEQ ID NO: 16702 - DNA, 839 bp, Citrus sinensis
  Predicted polypeptide sequence is orthologous to G214, G680
tttttttttttttttttgaaaacatactttctgcgcgcagaggccaaatcacggcctgttcaatacttgatgatttttgtccaagtcgtctattgaaaatggaattaagtgcagttgcataagttcaggaaggcaaataagtcaatgtcgacgtataatatagtacaacacccaactacacgaagagtcgtgaaatagacctcataataaacataacgaaataggtgggaaaattagaaatccatgcaaattaacaaaagtttcccttgcttaactgcatgcaataaccaatgtcaagttgttgctccttccacgcgtatcctcttggggcatttctcttcggcttggttgccggtgttgagtattctgttttctttggcctccacagaacaccttttgtaaggtttaaaaccagttcgacgggccttcagtttaccatgcccaagcccgatcgtcagcagcccctcccccccattgttctcgactccggacaccgtgcttttctccacctcttgatggccgaaacaagaaccccatgtcttgctgttgagatcgaaaagtgatttatctccatctttcttattgccgttttgcttatcctctacattgtcctgctgcattttgtccttcagatcatgtggaggtgaaaagctttgaggcaatacctctctagagaagagtgcttgaaaagccagccgccccacttcagaaacttccttccaagaatcggtaatgttactgctgcttctactacgacggttaccaggatcggtggcaggaagactcggatcaatttctttagactcctctttgcctttctcttgcttttctaatgcatc

SEQ ID NO: 16703 - DNA, 951 bp, Citrus sinensis
  misc_feature (32)..(32): n is a, c, g, or t
  misc_feature (907)..(907): n is a, c, g, or t
  Predicted polypeptide sequence is orthologous to G225
cccctcgagtctaagctatagtataagcttcntggtttccagttcacaataggtgactctctctccgaccagttgaagattgaatcaatcacactgatacagcagattatatatcgtatgtggatggggtttgtcatttatgaacagatttctcaggtcaaagatatcgtacgtacatggggcaacaactctttctcaccaggagacggagattagagagggacagtaggaccccctatcagcaaccttttatactctaccgtcacaattacatcttgcctgtaggtaggtgctatcctgatcttgcctgtaggtgctcgctctatcccgagcatttgccctttttgctgtgaaaccggatgtacaaagctagctattcccaaaggccagaagcagaaatggattaccggggcggggacgaattcgtgaaattgcaaaccgcctcggaagagaacagcatgactggcagagcaactaacaaaagtaaaagtggaagagaaaaatatcttaacgctagcagagttcagaacaaatgaagcaaaataaaaaacggaagcagcgttactgctcccgattcatcttgacccccaactattttgacagttccagaagtgacagagatgcagagatcttggcgaggctctttactttacagggagcgatctggaggaaaaggaataagaaagaggaggaacgaacacctacccggaaaacaagatcatgggcaatagcagcaaggtgaaggtcatttccttcctgcacggcacccctaaatagatgtaaaaagttgtaaatgtaaaacttccctataaaaagctctttttcgtcgtccacactgcagttattatttttaggtaatagggctacaaatcgttactagtccatccattggggaatgcttggtccnagcgggggaaccttaacaatcgcactactacacctaccctaccc

SEQ ID NO: 16704 - DNA, 809 bp, Citrus sinensis
  Predicted polypeptide sequence is orthologous to G249, G1322
tttttttagatctgctatatcaacacatatatataaggtcctatatattacaagccatagatataactaaagataaaagtttgagccccgctaatattataaggatccaaaatcataactcgaacccatgcatataaataatcatggtgcttaatccccgttatataaccagagatcctccatactccagtagttttcattgacttcagaaggaataggtgccatattatctaatggaaaagcttgatgaggatccatattattgtttaatggatattgtggtgctgaataatcttccatggtgtatgcagcagtggacatttggcttgagcttgcttgctcattggcctctgaactttgccctgaaaatgtttctgcttgcttaatttgcttctggattctggttctccaaaaattcttaatttcattgtcggtccttcctggtagatgctttgcaattttggaccacctgtttccccacttggcatgaagctccatgatcaaaagctgctcctctggtgtaatattccccctcttaacgtccggtcggagatagttcagccacctgagccggcaactctttccggtacgttttaggccagctgctttagctagtgagttccagacgccttcgccgtgatttgctatatagttgatgaggatcaagtcttcttccatggtccatggcccctttcggacttcagcttcttgagaattgcatggagttttatccatctcttaatttacatagagaaattaagaggaggagaagaagaagaagaagaagaaagaagaggaagagaaacctc

SEQ ID NO: 16705 - DNA, 842 bp, Citrus sinensis
  Predicted polypeptide sequence is orthologous to G256, G666, G668, G932
tttgatgaaaaagactaaggatatcatatatatgatcatcacataatattgtgaattttacactatgtcctattgatgaaggagtcccatctgaaacttaattaaggccactaaatggaattataatcagtagaactgtagaagagcaattacaaaataattaataaacagatcaaaaagagtctttaatgaaagccctaaaaccagacgcagctctctcatcagaacatatcagtgtcctcatgatcatctaatttaaggtcattaagataatctttccctccttgatcatcaaaaagccacttctcaagcaatgacagctgtggcatttgatcatcatcagcaccagcactaggatctaataacaattgcttgctctcataatcttgaaaagtgctagactcaggggtcacagattgagataaatcggtagaatttgacgaatcaaaagactcaaaaccaaacaacgattcaaaagcctctgataattctatgccagtactgttgcttgcaactttgcttggagtctcttcactagaagcagattctgccccagcaatgtgattaacattgttattaattgaattctgatcagtaacacctgagttcgaagaagcacttttttgagcgtttctggtccaccctttgagcaacttagcaatgttctcagtgcttgaagcgtaagctggtgcttgaactgctggttttgtgtaggaaatgaacccattagcaggcttcaattcagacaaaatactcgctttatctggtgacaaggccgcacatagagcttgcttagccatgtgaatatcagtctgcagccttctctcccactgaccccttga

SEQ ID NO: 16706 - DNA, 786 bp, Citrus sinensis
  Predicted polypeptide sequence is orthologous to G259
tttttttttttttttttaaaaaaaaagggcttccccccaactttaattaccaaccttaataataaattttaaaaagctccatcaataactacaatatttctatcccaacaaggctgcttccttattcattcaacttaagttaaacatactttttttttttttttgaaggcttaacttcttgaaattcattggaaaagggcaaactaactgaactatcttttaaaaaaaaaatacatacattatgtattgaaaacctacttaattacttcaatcaagaactatcaagcctatcaaaagggttacccaaattaaaaagaatcattatttgcatgattgaaaaagaaaaatgttacccctttgacaaaaaatctcagcgctctccctctttctcttcctttccctccccccctcatcaacttcaaatctaactccaaacaacttcactattaaggggcccctttggtaattattaatcccatgcccatcatcatcttcatcatcatcatcattatccatatttgcgaacttacccactaaatcaagcaactccttgcacttccttttcaggctaacaagctccaaacttaagttcccattctccttcttcaaacgcttattctcatccctaagggggttgaactccaaaaacaatgacgtcaacaacaacaacctttgatcttcatcatgaaattcttgttgggttcctgctgccgttgctgcttgctgcctgtttgcccatgcttttcttcaacgtatcttgcaaaaaaaatctttccccccctttca

SEQ ID NO: 16707 - DNA, 797 bp, Citrus sinensis
  Predicted polypeptide sequence is orthologous to G259
gcacgtgggaagtctttagcaattaaatagcattgcaattgaattctcatgaattgccctcgtggagtcgtattgggtttctattgttggggctgggagttcttaactgcaattctcatcttctccaatatccttcttcatctttagattaatcttcttctcttttagctaatttccctcttcaatatttcccttctttttttttttttggtctttttaattgtttgcgatatttgaaatatggaggctacaaataatattacaataagcagctgctgtgatgacaataagggcctactggaatatgccagaaaatcaacacccccaccatttctgttgaagacttacatgctaatagaggatccggccaccgataacgtcatctcgtggaacggcgacggcaccggcttcgttgtctggcagccggccgagtttgcccgggatctactgccgacactcttcaagcacagcaacttctctagctttgttcgccagctcaatacttacggatttcgaaaagtagcaacaagcaggtgggaattttgcaaccaaatgtttagaaagggggagaaagatcttttatgcaagatacgtcgaagaaaagcatgggcaaacaggcagcaagcagcaacggcagcagcaacacaacaagaatctcatgatgaagatcaaaggtcgtcgtcgtcgacgtcatcgttgtcggagtacaacaccctaagggatgagaataagcgtttgaagaaggagaatgggaacttaagttcggagcttgtaagcatgaaaaggaagtgcaagga

SEQ ID NO: 16708 - DNA, 899 bp, Citrus sinensis
  misc_feature (876)..(876): n is a, c, g, or t
  Predicted polypeptide sequence is orthologous to G261
tttttacacacaccaaaaaaaaagtaacttaaagagggaatatctatttattgtcaaatccaaccaataatacccaaaaaaaagtaacgtaagatactaaggcattaaaagctaggaaaacaaccaaacaatatcaagtcctctctgcaggggtaagatggcccatctgttctgcaagactatttacattcctcatattccaccaaaacttgccatgatcggcaggtttgttttcattctttttgccatcacattcctttctttctgactgaacttcctgggcgtcagaagaaccaggattctcagtcaaaaattgttcccaaaacacatcattgaccccagcttgcagaggaatggtggttgcagtctctggctcctttgaaggaacaggctctgtagctgcagtcacagcaggctctgagttcatgtcaattccaggagatttagggcgagcatcaacattaagttgtatgcaagatatagctggactatctgcacaacttgtagattcatccaactccaagcttgaattaggttggaagcaactttgaccaacgtcttgaacaatattctcccaaaatgtcatggaggactccaactgctcaaacttctccatgttcgaagaagaaatatcagcactatcagcacctgctacaatttgggaagtccccatcggattgtcttcaatgttggcttcatcatagaagtaatcaattcttggcagccttctcttcctatcatgattctccaagtgcgccccgaaatttgactcaagtccgggtttttgcaaggctcgacctacaaaagacaccatcttctgctgcctctgttccatcagttgaaaacgctccctcaaaagctgcatttgcgactcanatccttgccgctcctgctcatgt

SEQ ID NO: 16709 - DNA, 731 bp, Citrus sinensis
  Predicted polypeptide sequence is orthologous to G263
tttttttttttttttttaggacccccctctcatattattgacctgtacctaatagggcctggggttccaaaaccatttgcctttgatctccacccctgctacattatacaaaataattaaaactaaaagaccatcaacatccatcatacaaattatacaaaaacaaaccatgaaccgggggtatatcctatatcccaccacacattcaaaaaaaaaaatttgggggcgcagctggcagttgcaaactttgctgctgttgatatacggggcgcgaaactcaactttcttcatctcatgaaacccaccacacacgactgtttcctcgcgggggcgcttcttccgttcccctttcaaccaaaccccaaaaagcttcaaatctccaccgctactttccattttttcgtcatcatcagtatcaccgaccaacccatcgaggatggacccacagcttccttgccccatgatgcgattgatctgggcgggccccaccttcacgtactcgggcaaaaacgtaattaactcgtcgcactgtttcttcccctgcgccagttcggaactcagggtctcgttgtctcttctcaatttcgcattctcgtccgaaaagtccgcgaactttgcgggctcaaccgatccctggttcttccattccggaaatgacgtggacgtggaccccatgtcctcccctgaattcgaaggcgatgtcgctttcgttttcccccccgtttgagccg

SEQ ID NO: 16710 - DNA, 779 bp, Citrus sinensis
  Predicted polypeptide sequence is orthologous to G268
ttttttttttgtcactatataaatacacaaatgaaacaattctctctttttttcaatctcttcgtctgtgcaataaatttttggtagagcatcttcgctctcttatcttggtattggagagacacgactccatgttgttaattttaattttacagtctccccaaaaacagatggaagtctggaagagaatccaattgctctaagcatgcagaaggcgcttatcggccgtcaagatccggtaacttgcatgaggtccctcggctgtctcacgcaatgtcacatgccaacccatagctttcccaatctcttgaagttcatccatgacatcaattgagtcacgaatatatacatgtccatcaggtctgagcatccggtccatctcaagcatgatagtagacatattacatcttttcctctcaacagagaaaaggccagctgcatgcaatagatcataggttcttggatacgtatcaaatggttcgcaccaatcatgcataactcctattagtccgcggtcgtaaataacaggcaaggtattgaacccactaactggaaccacattcataacccagcaatcaaaatttttgctcaattaatgctgctgcaaatcctccaaagccagctctcatgtccaatacatttctcaacttcattttcttccaatgtaaagcacgaacatagctttctattatctcattccagtactttgattcagcctcgtgccgaattcggcacgaggtagaaacgaaaagctaacttccaacccttggaaaaacctg

SEQ ID NO: 16711 - DNA, 794 bp, Citrus sinensis
  misc_feature (522)..(524): n is a, c, g, or t
  misc_feature (756)..(759): n is a, c, g, or t
  Predicted polypeptide sequence is orthologous to G274
ttataattcttaaatatcgaaggagaaagagagatagagagagagagagagagagagagagagagaggctgagagacgtgcgtcgttgtgtttgatctataaatctatataataattctacatatctgtatggtggtagcagactagttgtaagacgttgatgatttcaaatttcacagtaaaaaaagacgtgaaactctgaaacttcaatagccgtacgctgatgaatcgaggcttttcagatactcattgacacgtcttacggccgttgtggatcaagcgccgtcaatatctacggtattatttcccttttagatacatcattgctttgcttgatcagagacaaagttcagccagtgtttgattgacgattggtcaatcatggcgttgaaatcgaattcatccgacggtagaacaaggagttctatacaaatatttattgtagttgggttgtgttgtttcttttatatattgggtgcgtggcaaagaagtggatttgggaagggagatagtatagctttnnnaatttctaagagtggggcggattgcaatattgtcccaagtttaaattttgagacccatcatggtggtgaagttgagagcattaatgaatctgaatccaaacctaaagtgtttgagccttgccaccctcgctacactgattacaccccctgtcaagatcagaggcgtgcaatgactttccctagggagagcatgaattatagagagagacattgtcctcctgaggaggagaannnncattgccttattcctgcacccaaaggatatgtaac

SEQ ID NO: 16712 - DNA, 868 bp, Citrus sinensis
  Predicted polypeptide sequence is orthologous to G274
ttttttttttgaaatcaataaactgaatatttcactatttgatcaattcagtacacaataatgattataaagaacatggtttgattcttgacatcactacaagattatttgatctttgactcaattatttagggagccacacaaattacattcttgcattcccctgccaaattttatgggaaaatacttggcaaaattgattgtatagattctctgcgtcaccgaaaaacgcgtattagtaacttacacttgccaatgagaactcttcagtcctccaaccgagagcaattcaatcactactcaagatgttatcttcatttaactttcatggaccaatcagtaagatggcttaatcggatgtgctatttcctgcactgccaacccaatactgtttgacagcaatcaatatcttctcaggcatgaggggtccatcctcgtgatccatcattttggtatcccatcgcatgccttcggcaaattttctaaccttgttcagggtatcaacttcgtcccggaagatgactgccccttctggccgcaagatgcggtccatttccagaaggatgtcttctggtttacacgtgttctcatacaagctaaatacaccattagcatgaataaggtcatatgtccttggatatgtagagaatccttcacaccagtcatggtatatgccaattaggcctctctcataaatgacacctaaagtgttcttcgcagttgttggtacaacattcattacccaagattttggcgattcaagtgccgctgcaaaccccccaaggcctgcattcatgtccatcacatttcgatatcttctggtgccaatcaaactgttcatctttttgtaagcatttacatgcttttt

SEQ ID NO: 16713 - DNA, 816 bp, Citrus sinensis
  Predicted polypeptide sequence is orthologous to G274
ttttttttgcaaagcataaccgtgtttgatttgtttgtttttaataaattgctacaaaagaacatgggccaattgatggttagtagtgaacataaaccgtgtaattctcatccctttgccaaaacacttgtgcagcaaaaatgctcaggatgaatatgaaacaaatcaaatcctatcaggactcaggatccgtaaagagagagcaacgccaacttagaaccattccaaaaacaaaaatacccatttgcagctcattatgaggatgtggagtttccactggcaacccagtactgcttgacagcaactaatattttttccggaactaaaggaccatcctcatggtccaccattttggtgtcccacctcattcctccaacgatcttcttcaccttaattatctcgtctacttcatcgcgaattatgattgcaccttctggtcgcaaaatgcggtccatttctagaagaatctcctcaatattgcatttgtccttgtatagactgaaaaggccatcagcatgaataagatcataggtccttgggtaagtagagaaagcttcacaccagtcatgatagatgccgatgagtcctcgctcgtaaatgacacccagtgtgtttttatcagctaaagtgggcacaacattcataacccacaatttggaagattgaattgccgcagcaaatcctccaaacccagcattcatatccataatgttgcgataccttcctgagtcaagaagtctgttgattttcttataagcatttacgtgcttcttccatttgttactgtcctcttggtatgactcagcagaaactcca

SEQ ID NO: 16714 - DNA, 716 bp, Citrus sinensis
  Predicted polypeptide sequence is orthologous to G275, G837
gaggcattgatattcattataaagaaccaatacaatcggatctcccttccattttagaagggtgaataatatgatatagaaaccttaatggtgctaaagaattatcaactgtatattctcacaatttctaatgaacaactacagctactattgcatattaaaatactagggtgcagattaatacctaataagcaaatatcaacttgtgaaatggcctcagagagtcaaaaacacaaactgaagcttcatgcttacatcatggctgataaaatggtttctgtttccttaggacgccaataagtcttgtgaacacaaagcattccttggttgtcattggtataaatcattctgacatcccagtgtagagatttaactaagtcctcaacctcaacaattgtttcggcatcgtcccttaaaatcaggtttccatctggtctcagtatcctatcaacttctgcaacaactgcctttaagctacacctctttttaatagtggagaaaagatgatcagcatgaagaagatcataagttctggggtacgtattgaatgattcacaccaatcatgatataaaccaaacaaaccacgttcgtagatgattggtagtgtgtcgggagagtcaattgggactacattcatgacccagaccttcaagtctttcaaagctgcagcaaaccctccatatacagccctcatgtccatgacattcctcacaaa

SEQ ID NO: 16715 - DNA, 852 bp, Citrus sinensis
  Predicted polypeptide sequence is orthologous to G275, G837
ttttttttagaacatttaattgagtgtgatatcacagtggaaattcagacgccaacccccatataaagaaataaaaattaaaaaaaattgaaagaaaatttgtaaaggttggacactgacaagtcaacttaacatgttccattgttacacaggataagaaaatttaaaaaattttaaaaacaagggaacctacttaacatagtgatacacaggacttagtagaccagttgctttgaattgggcaattgccaacttctgagaccaaagaatacctaatatctcatgagtgttgcggcctcaagaattttagagcactatgaaaggaaagcatgtttacgcaatagcatatttgatggtctccaactctttcggccgccacatggacttttcgacgcaaagcaagccctccttgtccttggagtaagtcatccgaacctcccactgcatacctttcaccatgctctctaactcattaattgtctcaacatcatcacgtacaattagctttccttctggcctgaggatccgatcaacctcagcaaccacagctactagattacacctctttttaatcttggagaaaagatggtctgcatggaggagatcataagttcgagggtaggtgctaaatgattcacaccaatcatgatatataccgaaaagacctcgttcataaattataggcagtgtatctggggaatctattgagattacattcatgacccaaacactgatatctttcatagctgcagcaaatcctccatagacagatcgcatgtccatgacattcctcacagttgaccagtttattcccatgccatttagatatgacttggaaactacccgcttcca

SEQ ID NO: 16716 - DNA, 805 bp, Citrus sinensis
  Predicted polypeptide sequence is orthologous to G280
tttttttttttaaacagccgctgaacataaaatttacattcaaattacagtcacattaacctctcaacattacaactccattaccacaacactcactccctaacattaattttaaaataaaataaaataaaaataaaaccatcaattagtaaaaactaacacacctaaaaaagaacctaatttaattaactaaatcaactccccttctctttctttcttcttcgtcagcttaatttcagtcaaccagctaccggcgcaacagctggcttcactttaggtggccggcccctccctctcggcgctccggtagctggagccgaaccagaagaagccgcggctgaggcgggagccggacccggaccgggcgcagtcttagccttcttaggaggtctgccacgtggcctcccactcccacccgaactcttcttcttagacgcagccggcggcgcgaatggatctctcggcttcggcggacgtccgcgcggtctcggcggcgacaacactgtcccgggcggcaacggatccttcggcttcggcggccggccacgtcctctcttaggcggcgcgttagggtcgggcttcatgtagttgttttttaccatcacgagctctccgctctgcttcattttgtttaagtggtgagcaagtaaggtagtgtgagccggcggcagatccgggtaagccgactccatttgcttcgagatctccgccttagacgaccccgccttctcgttcaatgcttcgatagccgccatgatcatctccggatattgcgggagagtaggaggaagctgttgatgttgag

SEQ ID NO: 16717 - DNA, 870 bp, Citrus sinensis
  Predicted polypeptide sequence is orthologous to G291
ggacgcgattttcttctacgacgaaggggcgcagaccaagttccagcaagagaagccctgggtcaatgaccctcactacttcaagcgcgtgaagatctccgcactcgccctcctcaagatggtcgtccatgcgcgatccggtgggaccatcgaggtcatgggccttatgcaaggcaaaaccgacggcgacgccatcattgtcatggacgcctttgctttgcccgttgaaggtaccgaaaccagggttaatgctcaggccgatgcttatgaatatatggtcgattattcccaaaccaacaaacaggccggacgtctggagaatgctgttgggtggtaccattcacatcctggctatggatgctggctttcgggtattgatgtttcaactcaaatgcttaatcagcagtttcaggagccatttttggctgttgtgattgatcctactaggactgtttctgctgggaaagttgagattggagctttcaggacgtatcctgaaggatacaagcctccggatgaacccatctctgagtatcagaccattcctttgaataagattgaagactttggtgtgcattgtaaacagtattattcattggatattacttattttaagtcctctcttgattgccatcttttggatctgctgtggaacaagtactgggtgaatactctttcatcttcgcctttgcttggtaatggggactatgttgcaggacaaatttcggatttagctgaaaagctggagcaagctgagaatcaattgtctcactctcgctatgggcccttaatagcaccccctccaagaaggaaggaggaggattcacagcttgctaagatcactcgtgacagtgcgaagataactgttga

SEQ ID NO: 16718 - DNA, 926 bp, Citrus sinensis
  Predicted polypeptide sequence is orthologous to G307, G308, G309
tggagccgcccgccacgaaaggtgaacctgatgttgacggagcgcgccaactcggcgagtcgcaacccgatttctcggagcgagtcgcggccgtctggcgacggcgggccaatgccggtcaacctcagcagcggaggcccgccgggacgaagagccagcgcctgtatcaacgccggccattgcaaaccatgcatcaaattgaaatcaaccacgtggacgcaatcgtggccgtcgaaagcttctaaaatggcctgattagccgtgaagtgagcgaatttcaagtaagggcaagcctcgtagaagtgatgatacagaatctcgttttcagaaaccgatccgcagatggagccgccaactcccataatccgaaagctcaacgcgtcgatgaagcaaccggcaactttaccgataccgcagctcggattaacgcgcgtcagcaagcctttcatatcctcaatcaaagagccggccactgccatctcgccacgttgcactgactcagcacacgtcatcaacatgtggaccagccttatcccggaatcttcttccatcgccgtaacaatcatcatctgctgttgctgttgttgttgctgctgagtagtagtgaaattatcggtgagatagttaccgacagccgtgtggttaacagaggggcccgctatgatatcgggtaggtcgggtagatcggacggtagagggagcgggggctggttgaactcggaaaggagagagtcaacccaagaggcgagatcagagggattgtaatggacggtatcggaagcgagttgggagatatcggcaggagagttgaccatgaccgtttcgaggcgttcaagtcgttgagctacttgacggagctccgaagaccgtactttgtacccggctcctgcaagtaacccatctatctcagcaacaggttgtttcgt

SEQ ID NO: 16719 - DNA, 788 bp, Citrus sinensis
  Predicted polypeptide sequence is orthologous to G312
ttttttttttttttagacagaaacccaccatcatgatcaacatccctttccatgaagaaacggtaagaagaggcaccttcttccatgacaaggttaacaagttatcgtgagactgattcaacgtgaacagaggactgtaattatagttccataacaaaatctcagcctgactaagtgcataatggctgaagggtatcccttcaaaatcggaattctccatgaaaatgcgccaattctcgatatcctcgacacgttctcttttggctccctgtttctctggtgcaagcaaatttgcaattcttggacccagaatttgtctttcaacttggaatctctcatctgagtccgtggtcatgttcggctccagggactcaaacacggcagtgtaatacttcaacgcgttcttgaacctggccaaaaaccccgtccgattcaaatttgcttcgtactctgcgagagtaaccacattcgggtttaaggattttgccatctgaagagcattttccacagcaagccggttgtcgtctagtaagctgttcaactgaagcatgaagttcacaaccaacgcctcgttcgggtcgacccgaaaactcgaggcccggagttttcgaatggggattagaatgggttcgaactccaagttcaatgagagagatccagcgaattcacggagacgatcaccagtagcgaggagcgaggcagccggggacttgccgagagctggagcgggtatgcctgagatccgaaccttaacgggctttccagttggtcgattggctaatgcttgt

SEQ ID NO: 16720 - DNA, 241 bp, Citrus sinensis
  Predicted polypeptide sequence is orthologous to G319
aaaaattccattttctttttccaatttcgagtcctagtttggaatcgcgaaagctcctcgatgccatgccaatagccgagacttgaatttctccatcggttgcgtttgtgggagtcaaattagggttatcttttttgtggtaatcttgtctttcgattatcgctaattcattttctgttctctccgttttagatttcttgcaaaccctagcttttgattaagtggcggaaaaaaaaaaaaa

SEQ ID NO: 16721 - DNA, 705 bp, Citrus sinensis
  Predicted polypeptide sequence is orthologous to G326, G1337
gttttgggatggacattcttgtggtcagggtgctcagatatgggattttaatttgggacgattgaggggcaatgaagaatttaaacaggtagaagttgcatatggtgcaagtgattcagtatttatgatcaagaacttcaatgaactgatgaaagaaacatcccttactaatactgaaatttttggagaaatgtacccgatgaattgtcccgtcacacatgatgacatggcatcatttaataataactcaaataacccaacagccaatcaggggtctgcaacatctgagagcaacaacctaccgatagcaaggccatcatcaggttcagcttttggaaagcccaaaggctctagtagctctaaaaatatccagtttgaacagccttttcttgtgagaacaactgcagcagccaaggccaatctggagctgctagcacaaaatcgagggaatgccatgcagcgttacaaggagaagaagaaaacccgaagatatgacaagcacatacggtatgagtcaaggaaggcaagagctgatactaggaagagagtgaaaggtcgatttgttaaagctagtgatgctcctgaaggttgaacacatgctgagatagagatgtttcttgcttgctcttttgtatataactctgacattcctacggttaatgcataattcagcagtctttatttgttgaaaaaaaaaaaaaaaaa

SEQ ID NO: 16722 - DNA, 609 bp, Citrus sinensis
  Predicted polypeptide sequence is orthologous to G328, G2436, G2443
gggctactgatctcggagtggtaccggaatcaaccatgagtgacatatcgatttcacactcgaggccaccgaaagggaccattgacctcttctcaggacctccaattcaaatgccaccccagcttactcccatggacagggaggccagagtcttgagatacagggaaaaaaagaagacaagaaaattcgagaagacaatccggtatgcctcaaggaaggcctatgcggaaactagaccacgtatcaagggcaggttcgcgaagagaaccgatgctgaagttgaagttgatcaaatgttctccgcaacattgatgactgatcctggatatggcattgttccttcattctaaatccatcgatgagtcgaagaatagctctcaagactagaggtctactgtttattactaaagtactactacttgtattgtagctctcttaatataattatctgaatcaatgagatatttcttccgtatagtaattttcttgtctattcatgcaaccatgacactgctatgttgtaaatgtatgtatattcataatttttggaattaatttcatcacgattattgctttcccaaaaaaaaaaaaaaaaaaaaaaaaaaaaaa

SEQ ID NO: 16723 - DNA, 891 bp, Citrus sinensis
  Predicted polypeptide sequence is orthologous to G343
cacaaacgtcgggctcgaagctggtcggtattcaggcacgagccgacccgacttgtagcgtacgccacacgcgttacaaagagtcttagggccgagaggtcccgtccgccactgtggcgtcttctccgatgcgcagtgcgtgcacctcctcactccgccttctggaatcggcgacgattgccggtgattctctcgcttctgcttcgaatttccagactcagattcggatgacgtccagttccacgtggtcgtgttagctgccgaatttgtcgcttttgaacgcttgcttcgtcctcttcctgataatgacgtgtctgatcggacgatcgttccggcaagggagtttgctggaaagtccatgcaggaatcgtctacgaactgcgacaaccactccagctccgccacgtcatcactctaatgaactcaaaacagtgtgattaaataaaaacaaagagaaaatgaatcaagtttttagaggaatataacttacggggacacagaggtcgcctgtgaagtcagaggagggattaaaggagtcaaaagactggtgttgcgcctgagggaggtggtcggtgtcggaggcgatggcggtggtgtttgcagtggcggcggaagatgaggaggtgaagagttcgtcgttggagaaatcaagaaggtcgtcaatgcgaaacaagtcttgagtggtagtgttattagaagggagaccgtagatatccattcggttgtggagttaaaaaaataggcgtcggtgattggggctcagctctctaagtttgttggtagagagtgatcagagaggacagagagggggagttgatgagttgattaatattgaaaggccggggcgggggggcagaggaacgtgcagggagtgaccatgcagttgcagca

SEQ ID NO: 16724 - DNA, 883 bp, Citrus sinensis
  Predicted polypeptide sequence is orthologous to G346
tttttttaacactcttgacttgctttcaattccactgagaacacataaaccagacaataaaacacacataaaagcagaatttttctaattaaatttttttttcccaaaacaaattaccaagtactaaatctatctgacttgattacaagaaacccactaatcctaaataagctaaactaaagaaggggggaaaaaaattaaaaaggacctactaaaactactctaccctttatctacaggcttgacacccagcaccccaagctcaatccccatcatttgcttctgtctcctcatctccaccacttttctatgcgagttcgagtgcaactcgctcgagaacgtcgggctgtttgccggccggtactccggcaccagcctgccggacttaaaccgaaccccacaagcattacaaagcgtctttggacccattggcccagcccgccattgcggggtcttctcagcgccacaatgctgacattttctccctataatcactttcgaaacaaccggtttcgcagctttcacactcccgtgaacactcccccaccaggcctcctggttcagaagctcgcggcggcaacgcgtgcgaagcttgctccgggcacgcaccggcacgcgcaggttcccgcagcagttcataataatgctgttgctattgttgttaccattggtgatagtgctgccattagtgcttgtgcttgaactgctgttgctgttttctaagaccgaatttgggctttgctgctttaagatgttggggttagaggaaatgtcgacgaatgtttcaactgtcggaaagttcgagagccattcgagttcttcttctgcacattcagggaacagacggtcagtatcatcaccggcttcgaaaacgtcaaagtca

SEQ ID NO: 16725 - DNA, 808 bp, Citrus sinensis
  Predicted polypeptide sequence is orthologous to G347
ggggaagaaaccaaaccaaaccaaacaaataaaactctccttttttattttcctttttttatttatttatattaaccacacaatcacgcaactgccgatcgacttcgatttttccaacgattcaattctcctttctcttcaaggtttaaaattgattgattgcgcgtgaacgcgttttaaattcggttcctttaaaagccatcaggtatgcagagtcagcttgtgtgcagtggctgcaggagcgttcttctttatcctagaggagctacgaatgtttgttgtgcattatgtaatacaattacatctgtccctattccaggaatggaaatggctcagctaatttgtggaggttgcaggacattgctcatgtatacacgtggggcaacaagtgtgagatgctcttgttgtcacacagtgaatcttgcaccagcacccaaccagtttgctcacatcatctgtggccattgccggacaacgcttatgtacccacatggagctccatcagttaaatgtgctgtctgtcagtatgttactaatgttaatatggcaaatgcgagggttccacttccagcgaacagacccaatgggacagctatccctggtactttaccttctacttcaatgacacaaactgttgttgtcgaaaatcccatgtctgttgatgaaagtggaaaattggtgagcaatgttgttgtcggtgtctcaacagagaaaaaatagccaagtggggttacaagatctcactgtttaattcggtaggatgcagtcttaatccttattatacaatcccggaaagacgggacatgaa

SEQ ID NO: 16726 - DNA, 894 bp, Citrus sinensis
  misc_feature (872)..(874): n is a, c, g, or t
  Predicted polypeptide sequence is orthologous to G351, G545
ggggatcatttccatccatttgaaatcacctctctctctctctcgaaactcaacagattcaaccacaagagtcgagaattcactaacaagaaaagaaaaaattcacgactatggctctagaagctctaaactcccctacaacaagcacccacaatcatcatccgtttagatacgaagactcatggactaaaagaaggcgctcaaaacgactccgtaccgacgagtccccacaactaccagcagcagcagcagctcccacggaagaagagtacatggctctctgtctcatcatgctcgcccgcggtaccaccaccgccaacaccgctccggccgaaagaaccccaaccctggcgccggaacagaagccgctggatcagttcccggagccgccaagtttgaaactctcttacaagtgcagtgtgtgcaacaaggctttctcttcgtaccaggcccttggtgggcacaaagccagccaccgcaagaacgctgctgacgcctcggcttctcccaacgccgcagccgccagtgacgtcaccccaccaccgtcggcaacggcgagcagcggaagcggtggtaggacccacgagtgctctatttgtcacaagtcttttcccacgggacaagctctaggaggccacaagcggtgtcactatgaaggcggcatcaacaacaacaacaacagcagcagcaataataataaaagtaataataatagcgacgttgttactagtggtagcgctagcgttggtgcaagtgcggtgacgttttcggaaggcggagggagcagcagtcaacgcggatttgacctgaacttgccggcgttgccggagttttggtcacaggaagttgagtctccgttgccggccaagaannncaagttgttgatgcactact

SEQ ID NO: 16727 - DNA, 865 bp, Citrus sinensis
  Predicted polypeptide sequence is orthologous to G351, G545
gaggatctgaaattaagctctctctctctctctctctctcgctctttcacactcactcttggttttagattcaaaagagtaacggagatggcactggaagctctcaactctccaactacttcgacgccgccgtttcacttcgaagaagctaatcttcactgccttgagccatggaccaaacgcaagcgctcaaagcgtccacacaatcctccaactgaagaagagtatctcgcgctctgcctcgtcatgcttgcacgtggcacaacctccaccgccgtcttaactaactgcaacacgaccaccgccgcctcacagcgacagaagtctcctgctctatctactgctgcaacgacgtcgtcctctgaccagaagcttctcttcaagtgcagcgtgtgcgacaaggcgttttcttcttaccaagccttgggtggtcacaaggccagccaccgtaagggatctgggggcggcgatgaacactccgcatccactaccaccaacaccaacgcaaccgccacgaccaccggcgtaccgaacgccactggtaggacccacgagtgttccatctgtcacaagtccttccccactggccaagccttgggcggacacaaacgttgtcactacgatggcggcgagaagagcggagtgacgtcatccggatccagtagcactcacagccaagtcagccaccgtgactttgacctcaacctccctgtcttaccggagctctcccctgctttcttcgtctccggtgatgacgaggtggagagtccactgccggcgaagaagccccgtcttttcttgccccccaaaatcgaagtttaatttacttaattgccactttttttttttgtttttgggctacttt

SEQ ID NO: 16728 - DNA, 866 bp, Citrus sinensis
  Predicted polypeptide sequence is orthologous to G353, G354, G2839
ggggcccattccacacattcaacaaaagacagttgagacagcaaaacattcgaaaaaaaaaaatctcaaatcagaagtccgtattcatccattcgctcattcatatttgagtctgtgatgaagagagatagagaaatggcagccattgacaccgcaaattgcttgatgctgctctcaaaagttggcgaaacagaccagggaaagcgtgtatttgcatgcaaaacatgcaacaaagagttcccatcgttccaagctttaggcggccacagagcaagtcacaagaagccgaagctgatgacgatggcttcatcaggggaagattttgatcaaacccagatgccaccagcttcccccaggaagcctaaaacgcacgagtgttcgatttgtggtcttgagtttgctattgggcaagcgctcggcggtcacatgaggagacacagggcagcagctgccatgggcgccgtcgccgatggattggtgactcgtcctcttttgccgctccccgttctgaagaaatccaatagttgtaaacgagttttctgcttggatttgaacttgatgcctactggggatgatttgaagttatgggtcgcttagttagttactttcattgttagtaattagtttatagcccttataaaaaaaaaatagtttatagcctttagataactggctttataatttcattttcagccctctgtatttaccgatttattgttcgatttattgttctcggattgactcatttatttgtacactgctaaaacaaaaagattcttattattgattctcatcatcagctttgctttcagttccagagataatgagatatcattttttgtacaaaaaaaaaaaaaaaaaaaaaa

SEQ ID NO: 16729 - DNA, 462 bp, Citrus sinensis
  Predicted polypeptide sequence is orthologous to G359
ttaagttttgattccggaagcagagatctttccagatatgaagaatatggaaacaacctgcgcaggtaatgatgattggttggagggtgcgccatggttgattgctgccagtattgttgatgataacattgcgaatgatgtcaatctcgatcttcttactgtccctcaatatgggagaaatattgatcaaaccggttaaatgcaagcaatattactcttttgtgttatgcttatttaaataaaaagatgggtactgttattacctatcaatgtgtgagtgtttgcttattcgggtttactgaataagatatcttgatatgtataagagtttttctttattttactatcttgtgtggtgtcttcctggaaaaggaaattagtgaataaaattgttgcgtctgttataaagtgttgattaaattagcctgtccatatatatatctgcttaattaaaaaaaaaaa

SEQ ID NO: 16730 - DNA, 754 bp, Citrus sinensis
  Predicted polypeptide sequence is orthologous to G361, G362, G370, G1995, G2826, G2838
tttttttttttttttttgatgccttcagaatcactctcttaagtaaccactataaatgattacaaaaatcaatacactagtccacgccataagggggaaaaaaaaacaaatacaaaaacaaaaaaccaaagaaagaaaggacattattccatgccttgcggcatgtatattgggattattaattatttaaacatgaggaagacagtttaagatggagatcaacgcctgctatgtcttcttgatcaggcaaattaatagaaaattcggcatgcgaatgtattgcaggagcaacgtgtaagggctgaggagctgctggtgatgatgaaagcaaccatggccgcctatgataatcgctagtaaattctctttgataaatggccggtgctgacttcactgcatgtgagctgattataggtgcagcggttgctaccgacacgaagcgttgctgatcgctgtgaaactgggcgcgttttgttcttggacgcccccttctgtgtgcattttgatgccctcctagcgcttgagagttagcaaacgctcgacggcaaaattgacactcgaactttctgttttttccactagttcttgttttgtcttgaatcttatcttgctgatcacgatcagttaatggaaatccaaatagctttaatgctgcaatgggtttagtatgattagtttgtttgtctctttgcatttcgtttgatggtaatttggctgaacttgagctctctcccatgagatgtagttgggcctc

SEQ ID NO: 16731 - DNA, 816 bp, Citrus sinensis
  Predicted polypeptide sequence is orthologous to G363
ttttttttttttttttgatgaaggaaattgaacaaagtatttcatacccagggtaagagaatcccttatagactctgttaaatgtaagtataggcaccaggaacagtaataggcatcgaaatacaagattattgaaattgacggtatctcttagtggcttttttagctacaacacgcataatgataggaaacataagaactcggagtttttttttctagttgttaggcagaaccaccatccttgttgaaattatgggctcctacccttgttagtttttgtacttgatgtattaataaattaagaactgacccaatagaaaagaccgtaaaaagaaaatttcaaactcagtaagaggactgatggatcagagtcggagatttaagtcaagcttgagaggctccgggggtggctctggaagttgtagattcaagcgaaagctgcctggccacatcacatctgttgcttcctctagcacgtaaggtgtccatgccattccaaaccctgtgtcggcatcattaaaccttgctccaacaccagctccgtctctgcttggcttgtgcacaagtgaatgggccctgacacctagtgatcgaaccatattagtgtggacgggcaagcccatcattgtcatcattctctgggattggtatcttttagctgcacctctctccctcttgtgggcgttctgatggcctccgagtgcctgtgaactgaaaaacttcctcatgcagaagttgcatgagaaaaccttagcggtagtcggccttgctggtgagtcaggatctctgcttgtcgagagtgaattccctcctagc

SEQ ID NO: 16732 - DNA, 872 bp, Citrus sinensis
  misc_feature (801)..(801): n is a, c, g, or t
  Predicted polypeptide sequence is orthologous to G377
tggaagtggaagcaaattgcttgcttctttgtcttctcactgttgttgtctctagccagagccaaaagccaattcttcttctaaaacttttagcaagaatagttattgcgccaagttttagaagaaaaaagtgttttgctttctggcttcttgaaaacaaagaagataaattttgaattttataacatgggtctctcaaatttccctagtgcagctgaggggttgctaccgggactggtaatgaacacagttttgtctgtggctttgctgaagaacatggtgagatctttgcttcaagggatgggagctgctagtgattcttcttcttcaaatgtcgaggatgaatcagatggattcattagttctaactcagaagatgataatgcaagagagaggagaatatcaataacccagttcaagtctttgtgtgacagcaggtccagttctagtagtactgatgcaagaagtaatggtggcagcacctcctgttcggcttcaatggaatgttgtgtgtgtttaagtggattccaatctgatgaggaggtgagtgagttgtcttgcaagcatttcttccacagaggttgtttggacaaatggttcgacaacaagcatagtacttgccctctttgtcgatctattctctagattggagaagcttttggttacttagtggattcaggtttttaatgcaggttttcactttttagaagatacaatactagtccttctatatttttggttgtacttttctttctctttttctcccttcaggcttcaggtttgatttttgctcaaaattanggaaatgttatgtgacaagctagcttttgcattgctatgtttgtgtacgttaacattattgtgtattattg

SEQ ID NO: 16733 - DNA, 691 bp, Citrus sinensis
  Predicted polypeptide sequence is orthologous to G378
gataccgtctcttttcattttctcttagggacgaagtattaagccaataccaatgcccatctctctttcttttctttataaataaaagcagctcatttgagtcttttattgtattgcataacgagaattcaattgttacaaatctttgctttggaccaaaagaaataatggagttttatgcatacccttctcgtttttctatgtcgtcgttgtctttgtgtggcaatttctttgaaagggttaaagaattctgcaattttgcggtttctgctgttattgggaacatcttctctgcgatcttcactttcttcttcgcattagtgggcacgttgttgggagccatgactggagctttaataggacaggaaactgagagtgggtttgttcgaggggctgcagttggggcaatatctggagctgtgttttcgattgaagtatttgaatcttcccttgttctttggcaatcagatgagtctgggatcgggtgtctcctgtatttgatcgatgttattgccagccttctaagtgggagacttgtgcgtgagcgaattggtccagccatgctcagtgctgtgcagagtcagatgggagctgttgaagtaagcttcgatgaggcaccccacatctttgacactggcctttcaaaggttaacaggagaatcagtcgataagatcccaaagataacaatta

SEQ ID NO: 16734 - DNA, 862 bp, Citrus sinensis
  Predicted polypeptide sequence is orthologous to G384, G385
ttttttttttttttaggccacacaaccagaactaatcactgaatatctatccaaaaaaacatattccaatcattttcattggtgtgagcttcaacattcaaagctctgtccaattacagctcactaaggactcatacgcttgaaacaaaagaaaagattagacaattagacgatagtccctactcgatcattggcactactctaattagcactaaacaaaagaagaaaaggtgaaatgtggagttattctaacatacatatatatcaaggtcatagttcactttcatctttgtttggcgaagtcaatgcccgaaccttttacccttgcaaggtgaggtgccttttgattgctgctctggccgaaagaaacatcacaaagcaaggattatgtaaggtgcgttcttgacttcttctcttcctaacaattttgaagcgaacaccatattactgccagtttcttctcttcctgcgcatgtcagattatctgcatgatgcattatctgtcataactgcagccttgatcctttcaacagtacacttgattagactgttcacagttgccacagatccaagagagagttttgccgttggaactgagtcaactaggatctgaaatgcaacggtaagcagagaaccaccggaaccaacctcaagaattcctcctccattaagtcctgggccatcaggaagtatggcaaaacccgacggcagaagtgcaacataatctgggtcacccccactcaagaccatattcattgccactatatcaacaggagcataaatcacatatgagccagtggaatcagtgcagctctcttgtagaaccagcatgttgctctggcttgaatttgcgctattaaca

SEQ ID NO: 16735 - DNA, 815 bp, Citrus sinensis
  Predicted polypeptide sequence is orthologous to G386, G707
tttttttttttttttttgagcacccaacaacaacattagctaacctggtcaccaagtcgttacagggagttcagttcaagttccccatttggaaaaatgaaaccgaaagcaaatagttaaatttaaattgcacaaaggaatacttcaaacttcatttcagttttgtttttttgacaattcataaaggggttgacctgagtcaatacccgaaccaccacccttgccttgtgttaagaatagtctctgctcgagtccgtgactcagccccatcctcatcaccatgcaaggagtttccacgcgcggttcgttcttgactcaacacccccgaagcaaagcaaacacactgtcacacgcgcccacgtaccaaagctgtctctctctctctctctctctgttcaccacaattcacaagccacgtgattagctacaattaaccgtagccatgcacaaagcaaaacaccccatcgtgtcaagttaaaaaaccaaacaccaactccattatcgtatcagctttcacattgaagagcggccttgatcttctgaacagtgcatgatattagattgttgaccgtctccacagattctaccgtaagcttggccgtcggaagactattcaccaagatttggaaggccactgttaaaagcgagccacccactctctgtgacccaccgttgctcccattcccacttgtggggccattagccaggggccctcgtgagtctggaccatctggaacaattgcaaatccagaaggaaggagagccacgtaggcagaatcaccaccgttcatcaccacgtgcatggccgggatgtc

SEQ ID NO: 16736 - DNA, 878 bp, Citrus sinensis
  Predicted polypeptide sequence is orthologous to G386, G707
tttttttttttttttttaaaccgaaagcaaatagttaaatttaaattgcacaaaggaatacttcaaacttcatttcagttttgtttttttgacaattcataaaggggttgacctgagtcaatacccgaaccaccacccttgccttgtgttaagaatagtctctgctcgagtccgtgactcagccccatcctcatcaccatgcaaggagtttccacgcgcggttcgttcttgactcaacacccccgaagcaaagcaaacacactgtcacacgcgcccacgtaccaaagctgtctctctctctctctctctctgttcaccacaattcacaagccacgtgattagctacaattaaccgtagccatgcacaaagcaaaacaccccatcgtgtcaagttaaaaaaccaaacaccaactccattatcgtatcagctttcacattgaagagtctttgaggagacaccggcagccaaacggaggtggcagcgcttaacacgattcctggaggctcaccgggatcgtcaacgctctttctggtcataaccctaacgtcttcatcgacattgccagcattgagcttgttccatttgtggacagttgaagcgcacaccccagcgcagaaattatcagtcattctctgtgctagcttcaacatgcttcgtcgcccacccgcagttattgcggtgtgatctctggcggagacgctggtggacatgagaatggctaggcactcgcattgtctttgaagggtggcgacccaccgttgggcgccgaagcccattccggagattatcaagggtttgtagagttggtggacttggctttcatcgtattctgcatgctcaacccatgtcacctttgagtagccattaggcatgtctt

SEQ ID NO: 16737 - DNA, 718 bp, Citrus sinensis
  Predicted polypeptide sequence is orthologous to G390, G391, G438
atggaagtttcacacatctattgactgattataggctagtagcataacttccaagcaatacaaacgcaaagcagtttagagagaagtaacataggcctaacaaccttatctgtcctaagtatccaaggtttccatggccaaaagataatacaatccaacaaaatacagaccttcgctggtccaaagtattttacacaaatgaccagttgatgaacataaagcagatgcaatgagcagtctcttcttcattaagtaccttccaagccacagccctctcgtaagaaaccggtctgcccatgcttgacaaacagatgccaccttgaagacaagcaaagccctgttgcattatctgggggaactccgcgaagagagccttccgcccatgatcatcaaatatcttctccaaggttatgtcttgcagtgcaaccaaggtcgtctcaagcatatcaagtcccgcttggtttgcaaaagtgaaaacaggcaatgcctttagtgagcagcacatgacagcatctgtgtgatgccaaaggtttttgagaatggattcacttccttcactgctggatttaagcagatccacacccaagtaacacctgtaactgtgacagatccaacgagcaagtgttagtgcttctggagtacctaatggtgtacggagaccagcttgtgaacttatattagaaggagatagggctaatgccaccctctgaacagatga

SEQ ID NO: 16738 - DNA, 849 bp, Citrus sinensis
  Predicted polypeptide sequence is orthologous to G390, G391, G438
tttttttttttttttttggtggtagctgctgcattttcatgaaactatttaagccaatacaataatgttttccacagaaaaaggactacaaagaagattgttctactctaaacctgcatctagattctaggttttgaccgaagtctcttctgtctttcaaacgaatgaccagttgatgaacatgaagcaaatgcagtgagcattctcttcttcattcaacactttccaagccactgctctttcataagagattggccttcccatgcttgacaaacaaataccactttgaagacacataaagccctgttgcattatttgcgggaactcaaagcacaaggtctttcttccactgtcatcaaaaattttttccagagttatatcctgaagcgcaaccaaggttgtctcaagcatgtcaagtcctgcctgatttgcaaaggtgaaaactggcaaagcctttagcgagcagcacaaaaccgcatcagagtgatgccaaagtgttttgagaatggattcatttccttcacatttaagtagttccgctcctagatagcaccgatagctttggcagatccaacgagcaagtgtgtgtgcttcaggagaaccaggaggaggtcgaagtccagcattagagccaaatcgagaaggggagagcgccaatgccactctctggacagaggctataataccacggacatactgcctagccattgatgctacattttcttgaaggtgcatctcaaatgcaaattgaaatgctattgtaatcacagattttgtgctgccacattgagtggaagagtcaccagatgctttatttccagttggtcctacttcaagagctgaggcaag

SEQ ID NO: 16739 - DNA, 843 bp, Citrus sinensis
  Predicted polypeptide sequence is orthologous to G394
gatagtaaaactgctttcatagatataacttgctttgtttcacaatttacaaacatataaaaaaaaagaaaaaaagaaaaaaagatgatgatgattttaaaaggagattaattagcaattaacataaaactatatataatctggagcatctagtaatattttctacagtttaattaatcacactaatatctctgatcactacaagccctgacccaaaaaaaatagcggggtttgttggagtgttccatataatttttataatttaatttaatctgattttcttttcctaatcctatctaacaactcaatcaacaagctgctgaaggattggtgaagggactatagcagtgaggcttagtacccatgggaaatgggcccttcgagtttccatcggcgatgccgccgccgatccgttcacaagaagggcacatcgtcagggtagctgccggcatatgcatgtaaagaggctgagctagcttcagagctttgagttcttgtagctccttgtgcagccttctgttttcatcagttagggtttcacagcatttcttcaagaattcacagtccacttctgtttgcttaagctttgtcctggctctcctattctggaaccatacttcaacttgtcttggtcgtaggtttagttgccttgccaaagcttgcttttgcttaggattgagagtgctatgctgtttgaagctttcctcaagaagagcagactgttctttggtgagtctaagtttctttctggcattaacaccgtcttcatcttcatcactggctcttgatgaaataactttttcaacctctatctcttcactgctaaggtctctctccctcttg

SEQ ID NO: 16740 - DNA, 897 bp, Citrus sinensis
  Predicted polypeptide sequence is orthologous to G409
tttttttttatccaaataattttttttttcaaataaaagatattatttaattacattctgaacaagaagttccattcaacactcaagaaactcctacaagaacaaaaattacaaacggggcaaagccaccatttttctctttcaacagcaatcaaaatccaccaccaattttgcattagggtgccattgattgaatttatttcttattcctaacttacaattcgaacatgctttttaaaaaaaacaaagaaagacacaggcaagataaacttatataccaaggattcatgatcagaaggaccatgaccaaaaggcgtgatcttcaatggggaatccgaagttacaggaattcgtgggcgggtccgagtattcagtttcttcaagctttgggaagacgtatggaggcaacaggacattcttgctcaagctatcatcttcatcttgtgataaatcggactgttcaggttcaaaaacataagatgaatcacaagtttctaggagtgaagagtgaaccccatccgtgtaatgtgggctatccgaatcaaatatgtcacttttggctgaacttatatcttcttgcttacaagccacaactgaggctttgcatactttaccctctgaggcagcagaatcagcaacaggttctgaaatttgtggtggttcttgtttgtttactacaggcaattctgtgtttttactctctttctctttgacctgcagcttgtctgtgagcttaagaacctcagcttttagcttttctttctccttgaagagattgtcataatcggccttaaggctattatagctgttttgcaatacatcgtaatccttctcgagctgtttagtcttccaacgagccgggcggttttggaaccaaatcgcaacctgtctaggctg

SEQ ID NO: 16741 - DNA, 743 bp, Citrus sinensis
  Predicted polypeptide sequence is orthologous to G409
cccctttttttttttacccaagaaatgcattattgataccgcaccattgatagtaaccataataacaagtgagaatcagcaaattttgcactgctgagaaaagatatagaagcacatgtgccacgtgacatagcttcaggtgaggccagccaatggccatgcactaaaactgcagatacacaatttacttagtaaggccaggaccagaagagctgatcttccaaagagaatccaaaattcctagaattggttggtgggtcgtcatagcagcaggaatcttcaagttttaataagtagtgcgaagaatcaggaggatcgatcaaagatgaatggttcccatctgtgtagtgtgggctgtccgagtcgaaaacgtcactcttggctgaatttgcatcttcctgcttacaggtcaccactgggacggaggagaacaaagttttagtctcagcgcttgtgactggtttttgaggttctgccactaataacttgacggcatcaaatgtttccaaaatttccttccctttttctttaagaagcaacttatccttcagcgaaagaacctcattttgcaaaacttgcttctccttgaggaggttgtcatagtcatccttgagcttatcataaacagctttcaaagaatcgtagtccttttcaagtcgttggttcctggaccgagcacgccggttttgaaaccaaattgcaacttggcgaggctgcaacccaagctcctttgcaagttggac

SEQ ID NO: 16742 - DNA, 700 bp, Citrus sinensis
  Predicted polypeptide sequence is orthologous to G416
tctactgccaacaattcttccaatgtcactactgccgctgatcaggagcctcagaaagaagtggatgcagcttgtattctgaataatggtagtaataacaccaaggaggagagctcaaaaactgaaggcagtcatgagagcagtgctgagattctcccttgtaaatttgcttccatgagaaagtcagctgagggtcagacccctgacttacctgcttcttcagaagtccatgggagcacagcaatctcagctacgtcatctgtttctgaaagtaatgcagatatgccgaacatcactgctactgatgttgtttcgtattgatttatttcctctcaatgccaaggttttatgatgggcatgaagctattgtaatgtaggtaataaagaaaagtagagaagcatatacaaagaacaatcctctagatgtatagcgaaaattatacctgcactgaagatcagtagagactctggcaagaagaaagattaccagcatctccgtcaatacaatactactaacaacaaatgcatattggatacttaaaaggaaagatcaactaatatgagagtagggcttttcacttttctactttttagctctgtaggtgtttgctggatcacaactttagcctctgaacaaaagactatgactcttattacatagttataaatacatcttctttatcaaaaaaaaaaaaaaaaa

SEQ ID NO: 16743 - DNA, 648 bp, Citrus sinensis
  Predicted polypeptide sequence is orthologous to G427
gttgcctcttattgatgcacagttagctcagtcccaccacgttctcaggtcttatggttctcttcaacaagctaataataataataaccactctctctctccccatgaaaggcaggagctcgacaacttcttggcacagtatttgatagtattgtgtactttcaaagagcagcttcagcagcacgtcagagtccatgccgttgaagctgtcatgggctgccgtgaaattgagaatactttgcaagctctcaccggagtatcattgggtgaagggacaggcgcaacaatgtctgacgatgaggatgacctacatatggatttctctcttgatcaatctgcttctgatagtcatgatttgatgggttttggtccattacttcctactgaaactgaaaggtctcttatggaaagagttagacaggagttgaagattgaactgaagcagggttttaaatcaagaattgaagatgtaagagaggaaatattgagaaaaagaagggccggaaaattgcccggtgacacaacttcagtgctcaagaattggtggcagcaacactccaaatggccatacccaactgaagatgacaaggcaaagctagtggaggagacaggcttgcagctaaagcaatcaacaactggttcatcaac

SEQ ID NO: 16744 - DNA, 884 bp, Citrus sinensis
  Predicted polypeptide sequence is orthologous to G427
ggggcttcttagctcttggcctcttgcatgtgaagagcaaaagcaaaaacgaaagtaggtaacaacaaatggcttataacgaccaacaaaacatgcaaaggctcgtccttccgacgacgtcgaccaacccgccaccaccaacctggctgaacaacgccgtccgccaccatcaccaccaaaacaacgacgacgacgacgacgacgaagaagaagctccaaaaaacaacaagaacaacagtgcaagtaacgacaacggcagagcggaggattgggagactgtaaaatgtaaagcagagatagtgggacacccattgtacgagcaactgctgtcggcacacgtgtcctgtttaaggatcgccaccccagttgaccagttgccaaagattgatgctcagttgtctcggtcgcgggatgtcttggctaagtactccgctgtcgccaatggacgcgtgctcgatgataaagagctcgatcaattcatgacgcattatgttcttttgctctattcctttaaagaacaattgcaacaacatgtccgggttcgtgcaatggaagcggtaatggcatgttgggatcttgagcaatctttacaaagcttaactggtgtatctcctggtgaaggcacaggtgcaacaatgtccgatgatgatgaagaccaggtagacagtgacacaaacttttttgatggaagtctggatggacccgatagcatgggatttggtcctcttgttccaactgaaagtgagaggtccttgatggagcgtgttaggcacgaactgaagcatgagctgaaacagggttacaaggagaagattgttgacattagggaagaaattctgcgtaagagaagggctggaaaattgccaggtgacaccacctcactt

SEQ ID NO: 16745 - DNA, 874 bp, Citrus sinensis
  Predicted polypeptide sequence is orthologous to G427
ggggacacacatcagcaacagcaacgaggacagcaagtcaacagcaacagcacgcacatggcgtttcaccacaatcacctctcgcaagaccttcctcttcatcacttcaccgaccaacaacaacagcaacaacaacaaccaccgtcacctccacagcaacaacaccaccaacaccaacaaagcatcgaaacgacagcgcctaattggcttaactctgcgcttcttcgctcacaacaggcgcagcaacaggcggctcacttctccgacaccaatttccttaacctacgcaccacagcaaacaacaacaacagcaacaacaacaacactgtctccgattccgacgcttcgcagacgccgaaccaatggctctcccgcacgtcctcctctctcctccaccgcaaccacagtgacgtcatcgacgacgtcacgcctgccaacgactccatcatcgcggccgtcgaatccgccgatttgaagaacgccaacagcgagaacatgaacaacgccagtactaataacaagagcgaaggggtggtggtcgagagcggcgccgacggagttgtcaactggcagaatgcgaggtacaaggcggggatattgtcgcatccgctgtacgagcagctgctctcggcacacgtggcttgcttgaggatcgccacgccggtggatcagctgccgaggattgacgctcagcttgctcagtcgcagcacgtcgtctctaagtactccgctttaggtgccggtcaaggcttggttactgatgacaaagagctcgatcagttcatgacacactatgttctgcttctttgttcatttaaagaacaactgcagcaacatgttcgggtccatgcgatggaagcagtgatggcttgct

SEQ ID NO: 16746 - DNA, 448 bp, Citrus sinensis
  Predicted polypeptide sequence is orthologous to G427
ataatgcccactcatcgaccacgtcactcctaccaacgacttcatcatcgccgtcgttgaatccgccgatttgaagaacaccaccagtcagaacatgaacaaggccaatactaataacaagcgcgaagaagtggtggttgagagcggcgccgacagagctgtgaactggcagaatgcgaggtgcgaggcggagatattgttcgcattcgttgtacgagcagctactctcagcacacgtggcttacttgagggtcgacacgtcggtggatcagctgccaaggatttatgctcagcttgcttagtcgcagcacgtcgtctctaagtacaccgctttaggtgccggtcaaggttgggttactaatgaccaagagctccactatgtattctactttcaaaaagttattattggttttaaatttaatttcttttccaaaaaaaaaaaaaaaaa

SEQ ID NO: 16747 - DNA, 946 bp, Citrus sinensis
  Predicted polypeptide sequence is orthologous to G427
ttttttttaactactaactattgaacttcttataccataaataatgtttgcatatttaatctgcattacagtaccaaaaaggctataaggaactaaacaaaagattattgcactgtacaaccttgacccttcactgtgcttattcacagatatgataagcaaaaacaaaaattataaatccaccaccaatatgcgacaatggattaactcagttacagtcatataatttcccaagtattcatgtagctaatcatatggcgtagaatacgtggcaccgttttacttgccttttaagcataactgcaaaatggtgtcaattgcgttcataacaacctcatcagcctccttgtttgccagttttgtttttcctagtttccaaagccgtttctgaagccctatctgtcacagtttctatgtaatatgagtatgttgaattttatcaccctggcattgaagcattggatagtcttgcatttacatgtaacgatcactgctgttttcacctcttgcgtttgcttttcaagactgttgaagttgaaggattactgtgccagttcctcttccgctgattgatgaaccaattattgatctgttttaattgcaaaccggtttcctgaaccaatcttgccttatcttcctcagtagggtatggccacttggaatgtgattgccaccaagatttgagaacagaggttgtgtcaccaggaagttttccggcccttctcttgcgcagaatttcctctcttatgtctacaattttctccttgtaaccctgtttcagttcatgtttcaactcttgcctcacgcgctccatcaaggacctctcactctctgttgggataagaggaccgaatcccatggtgtctggcccctccaaacttccatcaaacaagttggcatcgctgtccacttggtcctcatcatcatcagacattgttgcgcctgt

SEQ ID NO: 16748 - DNA, 727 bp, Citrus sinensis
  Predicted polypeptide sequence is orthologous to G450, G456
ttttgttaacccatataaccacatagcaaagcaaaatttggcaaccttagacctaatgacaccggaaaaagttaatcatttgccggaatccgacacgaagctcacgttaggcttacccggcggcggcggcgagtgtcaccggacgaaagccggcacgaagcgtggcttcttagagaccgttgatctaaacctcatgagctcaagcaacgataacaaacattgcgaagagaacgatgcaatggcctcgactacaaccccagcaaccaaggcacaagtggtggggtggccgccggtgagagcatatcggaaaaatgctatgaagggcagctgcaaatttgtaaaggtggcagttgaaggagctccatatctaagaaaagttgaccttgagatataccatagttatcaagaactcttgagtgctttagaggatatgttctcattcttgactataaggaaccacgtaaatgagagaaagattatagataatgtaaatggagttgaatatgtacctacttatgaagacaaagatggagattggatgttagttggagatgtgccatggaaaatgtttgttgaatcttgcaagcgagtaaggttgatgaaaagctcagaagcaattgggttagctccaagaacacctgcaaaaaattcaagcaagagttgaagaatgaataacagaataaggggcttattgtataaggaggcattcctggagtgacaattaatg

SEQ ID NO: 16749 - DNA, 772 bp, Citrus sinensis
  Predicted polypeptide sequence is orthologous to G450, G456
gaaaaagaaaaccagaactactactctcgataccctctcaaaatacaaacaaaccaaccaaaaaaaaaaaaaacaagagagtgataattaattaattaagagaggagtttaaggagtgtttagtgtgtaaatttgaaagtttcattaagatgattaacttcgaagcgacggagcttcggctagggttaccgggcggtaacggcggaagcagtgaaggcggcggcggtggtgagaaagccaagaacaataacattaatggcatgaagagaggatttgcagacaccgttgttgatttgaagctaaatctttcaacaaaagagtcaggtgggattgatgtaattgagaagacgaagggcaaaagtgcttctgctactggggctacagacctttcaaagcctccggccaagtcacaagttgtgggttggccacccgttagatcattcagaaagaacatcatggccgtccaaaaggacaatgaagaaggtgataataaggctagcagcagcagcagcagcaatgtagcttttgttaaagtgagcatggatggtgccccatacttgcgcaaggttgacttgaagctatacaaaagctaccaagaactctctgatgcccttggcaaaatgttcagctctttcaccattggtaactgtgggtctcaagggatgaaggattttatgaatgagagcaaactgattgatcttttgaatggctcagattatgtacctacttatgaagacaaagatggagattggatgcttgttggtgatgtacc

SEQ ID NO: 16750 - DNA, 442 bp, Citrus sinensis
  Predicted polypeptide sequence is orthologous to G450, G456
tttttttttctactggaaaaagattatttataaacacagacacccatttgtagtcatgaacagtcaccaatcataatacatgaaagagaaagatggggtgcataaacccataactggaacctgcgatgggactacagcattatttgttgcctactagaacgttccccttactacaagtctatactaagaacggtaagtaacactacaggaaatggagcacccaatttgagaccattaaagtcactttaacattcagaaaatatcaaccccgaaggtattttgcccgtggtgagtagcaacaggatctaactagttacgattcttgcacttctccattgctcttggggctaagccaatagcatctgaacttttcatgatccttagccttctgcaagagtccgtgaacatcctacaacaacagacaaaagaacccttagcaaag

SEQ ID NO: 16751 - DNA, 858 bp, Citrus sinensis
  Predicted polypeptide sequence is orthologous to G451
ttttttttaacagttgcatttgatgaagcagcaacattaagttcctggtatgtagtttcaattagaagggcttggaacaacacaatgacaatagatgctcagaaccatgcatcaaattgcatcttgatgtcaaacttgagtcaacagaaaaaaacttcaacttctctatatgcttaatttttgcctgtttaattttgcatgccgtctagtaattaactccccgatacccatatcgagggagaaaacaagatcatgaacccagatctgaaaattttgatcttcttccgagaacccaagcagctgatcaaagaaaagatttgcacgctccccatgagatcacaaatcttttatcttttcgtcattctctattatcatctgttaattaatatattaatttgctgtgagtcctcttgcttctgatcctttcatgattctcaatctcttgcatgacgacataaacatctcccatgggacgtctcccacaagcatccagtcgccatctttgtcttcataagtaggttcatattcagatcctttgtagccttctctttcggagtacacaccgacggtgaacttgaacatgttctctaaagcctttagaagctcagggtacccattgtaaagcttgagatcaatcttccttagatatggcgccccatccatgctcactttcacgtaaatcccagcacactcaccctcatttttcttctgctgtaagctatttttcctgtatgatctaattggtggccaccccactacttgtgccttggcaacggaggcagcttcatcggatttgtccttggtgtcgagatcgtcgggggtatccggcaacgaacgcttgttgtttcttgtttgttg

SEQ ID NO: 16752 - DNA, 864 bp, Citrus sinensis
  Predicted polypeptide sequence is orthologous to G470
ttttttttttgtataaaacttaggctacttacattaagaggttggaaaagaggggtaaacaactatgtacaaaaagggatcgttcgggaaagcaaaagctagaattgccatgctcaaaatagggggtatacatattgaatgtattatatgagtcggacaccatataccatgcccaaaattggatagtcatgccgtctacgaggaggattgacatccatctattagttcataatccaaaatagaatgccctgaatatcttctttctgatgctgcaacaaaaccttgaaccatcaaaaccacacctaaaaattctctgcattggatgctaaaggaagtggctgtttcacttcttttgcatcaatgccgtccccattcattggactatcctcacccttcgagctaaaagacactgagttcatcttcaggacctcctcttttgtgtagatgaaaattttgcgtaccataccacaaaactcctgccatggatcatctccaacaagcatcatgtcaccctcatcatcagtatatacaataatccaatttttcttgggagccattaattcaccatcaaattcaaataactgatccagttcggcaatcaattcgtcatagttgttgaacttagaaagatccacagacctaccaagtgcaattccctgcttttgaaccttagtacaactcctagtcgaaccacactgtgttttgctacgaacatccttagtgtgggtctgagaaggctgggacagtttctcgtgctcattgaaaacttgattatcatctgccaattttgagcttttagaatggtctgacttttgatctgattcaaatgcacgaaattgttgatctaagtttccagccgggtca

SEQ ID NO: 16753 - DNA, 779 bp, Citrus sinensis
  Predicted polypeptide sequence is orthologous to G477
tttttttttttttttttggctactgaaaacaggaataatcctttaaagtatacactaaaaagttgaatttgtaaacaagtgaatatgtttttgacaacattattgagaaaggaaaatacttgaaaaggattaggcctcaaggacttgcaactaccgttgaacaccaaagtattagaaacttgcagtcagcagggggaattattaactcttaaaaaaaaaaaaaaatgactttcttgattgccgtggggtgggcggggatctgaactttcgatcttccgcaggggtgcttgcttccttgtgtgctttgggcacctgtttcaaaacaagcaaattgagtggctgtttctccccagtgaaagttctgtatgcatcattgacaataactactagtttatttatatgcctgccatataatgaaaaaacgttcaaataaactatctatttttttattgttttgaccaaggaacttcttgaaattttgccctgtctgcggaacatttttaagtgattcggaggcagcaaaaagaatcattttcatctttaacttgcatgaactgattctgatgctccactcgttgaagctgtgatgacagttgaagcaagtcaattgtggccccatcttcacatgaaaggcgatccttggaactcatgaaatctgaccctcggtagaatcgattgctgacgtcaaagttggcagcagcactgctatcagacatcagaatggaacctaagttgcttccttcaaaagaattgttccctgacaaagagaatttatttga

SEQ ID NO: 16754 - DNA, 832 bp, Citrus sinensis
  Predicted polypeptide sequence is orthologous to G483
gggagatcaaacacaacaacaacaacagcaacagcagcagcctgtgatgggggttgtagctggtgctggtcagatgtcatatcctccctaccaaacggctcctttggtggcttctggtactcctgctgtggctgtcccctccccaacccagcctccatctactttcgccagttctccgcaccagcttgcctaccaacaagcccagcactttcaccaccaacagcagcagcaacaacagcagcagcttcagatgttctggtccaatcaaatgcaagaaattgagcaaacggccgacttcaagaatcacagcctcccacttgctaggatcaagaaaattatgaaagctgatgaagatgtgagaatgatttcagcagaggcccctgtcatatttgccaaggcttgtgagatgtttattttggaactaactctgcggtcttggatccacacagaagagaataaaaggagaacactgcaaaagaatgatatagcggctgccatttcaaggactgatgtttttgatttcttggtggatattattcctagagatgagttgaaagaggagggacttggggtcaccaagggcgctcttccagtggtaggttcacctggtgatatgcccttatactatgtcccgccacagcaccccgtggggcatacagggatgatcatgggaaagccagtcgatcaagcagcactttattctggccagcagcctcgacctcctgtggcttttatgccatggcctcagagtcagagtcaagcacaacagcagcagcaacctcaacaacagcaaaatgacccttgaatgacttatcgaagcttttgaacatta

SEQ ID NO: 16755 - DNA, 934 bp, Citrus sinensis
  Predicted polypeptide sequence is orthologous to G484, G2631
tttttttgaacaaagctcactaattacattaagttatagacaatgatccataagataaagtacaaatggaagtgcatatccacataggccactgcactcacaaaggctttttgtacataatataagagactaaaggcagaacagaaagagtcaaggatgcttgcctatggttggagaaaattaaaagtcctatagttagttagctctctaaacttgggttaatgtccggttgcttgggagggccagcggctccaccgttcattcgtgcacgtgcctcagcaaacattctctgctgctcagccgctgcttcttcctccgtcatctcggccccattgctccatttgccacctttcaacgagtcctgcatagtctcaagcttgtgttgctcgtatgcagcatagacctcctcgatgtactcaccaaacccaagaacctccaaagccttgagtacatgctcgggagcaattgttcttttatcctccctgctgcaaacttcattggactcagaggaaacaagatttataaactctgcaaagcattaaaaccaaaaattttaaccattatgataatatccatttgacaattaaagtgtagaacaattagtaatagagaactactaatggaatgcatttttttctcctaaaaaaatcatgatatatgtatataaaagcatccaagaatattttccacctaatgcatttaaggcacccacaaggactgccagatttgacttgttatatctttgaagttgtgcggtaaaaactgtagtccatgacaataattgaaaaaaaaagtaataaaagaaacataatcatctaataaatcagtaggacaatgatcatcatgttctctcaaatgggttaacatgcctttcgtaaactttcatgttatctcaagaaatttcggatcaagggaaaaaaacataatcatctaa

SEQ ID NO: 16756 - DNA, 946 bp, Citrus sinensis
  Predicted polypeptide sequence is orthologous to G489, G714
gggatcaccagcagcaacagcagcttcagcaacaactccagtctttttgggccaatcagtaccaagaaattgaaaaggttaatgatttcaagaatcatagccttcctttagcaaggatcaagaaaatcatgaaggccgatgaggatgtgagaatgatatcagctgaggcacctgttatatttgcaagggcatgtgaaatgttcatcttggaattgacgctgcgttcctggaaccacactgaagagaacaagaggaggacactccaaaagaatgacattgcggcagcaataactaggactgatatatttgatttcttggttgacattgtgcctagggaggacctgaaagatgaagtacttgcatcaatcccgagaggaaccctgcctgttgggggacctcctgatatgccgccatattgctatatgccaactcagcatgcttcccaggttggatctgctgggatgatcatgggtaagcctgttatggaccctgcaatttacgcccaacaatctcatccctatatgggtcaacagatgtggccccagggagcagaccaacagcggtctccttcagaccattaggtgctgtagcatccagttagcgaagaaataagagggagtagggaggcccctagaaaccaaaagcccactgttgagtttcaggcaaagagaagcagaccttttgtaaataatatatgttttcgaaagagtagctaaacttttattggaccctctcgggtgatcctatttccggattactagtcagtaaccattacttaaaagttcatgtacaatttatatattttgaaagagtagctgatctcgatcgaaccctttttgtatcctgggtgctaactttttcatttatagatttagtgatggttactttagaaagatgtataaatagaaatttaagtcaaaaaaaaaaaaaaaaaaaaaaaaaaaaa

SEQ ID NO: 16757 - DNA, 967 bp, Citrus sinensis
  misc_feature (43)..(43): n is a, c, g, or t
  Predicted polypeptide sequence is orthologous to G502, G519
tttttaaacaaaataagacacactaactgatttgatataacantttttggaacactacatttaataacttcctaaaaaaaaagaaaaattaaaacatattaacatcatcacatgccgcgtgctgtacacatgctaatgattaatgattatatgcttgcaaatccagcattaaccgtccgatcaatcagaccaatcgtccgaaagaacgtagggcttactatatcgtcaactgggccccgcaccgcacaggcacactcattgactttcgtctcgtgttgcctctttcaaggccaggccaggccaggccagcccgtctatggtccatccactcgacccaaatttaaaagggtttcggaaggtacatgaacatatcctgcaacggcgacagctgattgtttccctgaaactgagaattgaagcttatgtccatggtggaatccaagtaattatatggaaaaccaagggtgttttcccagggttgcattttaggctcgctctgcacctcgcacgtgaactccggtgacaccacgtgctccgagcaactcgagtccgtgttcagcttcggcaccgaatccgacgtgtcaaaatacatgtaatcattcactgttcccgttcctgttacggtcgacgccggattcggaatcagtgctcctcctgacgttgacttgtccatgccacttggcataaccaccggtttcttctcctccgtctccgtctccgtctccgtaaaattcggcctccgattagtgacctgctgttttttctcaatagatcccttcttgttgtatatgcgacacagcacccaatcgtccagccttaagctgttcttcttacgagccgagcgatccacgtcagctaaccgatactcgtgcataatccagttggttttctctcctttaggcgcttttccggcgtaaaaaacaagagccttcttaattccaacgggcttcggctggccaatcggctt

SEQ ID NO: 16758 - DNA, 771 bp, Citrus sinensis
  Predicted polypeptide sequence is orthologous to G502, G519
tttttttaaaaaaatttcttctacaatcttgcacgaataagaatgccctacaattgtggtttacaaaaggattatataatacaggacctagcatactacgatgtattgaacttaaaatggcttctgcagaatcataaaaaggtcttgatagggtgataactgatccatctgatactgaacttgcgggccaaaagggtcgtcttggaagctattagtgtccatgtagttgaaattgaactgattataatcatcattcaaggcattgcctagatcattccatttgggcatactttggacctccttatcgcacgtgatctccggcgacaacacgtgctcggagcaactcgaatccgtctgcaaccggggcaccgagtccgacgtatccatatgtaataggtcattcatcattggcgcaggcgatccctgatgtggaggcattcctaatgctacctcttgacgtgaaatgttaatatttggtttccgatcctcctccagttctgggaatccaattgatttttgatcgctggggtaatgtttttccatcctccccttcttgttgtacaatcgacataatacccaatcgtcaagccttaggttgtttttggtggcgggggatctgtgaacattagcagggcgatattcatgcataatccaattagttttgattcctttaggcgcttttccagcgtagaacacaagcgccttttttatacaaagagtcttcggcttcccaatgggcttgtccgctccggtcgccttccagtatccgga

SEQ ID NO: 16759 - DNA, 811 bp, Citrus sinensis
  misc_feature (717)..(717): n is a, c, g, or t
  Predicted polypeptide sequence is orthologous to G521, G2887
cctgaagtggtatttcttttgccacgagagaagaatatgcaaacggagctaggatgaatcgtgccactgagtttggttattggaaaactactggaaaggatagacctgttcaatacaataatgaagtagtggggatgattaagactttggtttttcacaggggtaaagccccacgtggtgatcgaacggactgggtgatgcatgagtatagaattgatgaacctggtctttctgaaagaggagttgttcaggatgcatacgtgctctgtattgtttttcagaaggatggtccaggccctaggaatggcgcccaatatggagcaccatttagagaggaagactgggaaaatgatgaggatgttgattgtgtggatgttatctcctctgctgtacttcctccaccagtgcccagccagaacagtcctgtagctgagagctcccacatccctgagaggctatgcatcggaacatctgagtcatgtctttctgatactatcccacccacttctaacatgcttccaccagtccctgttattaatgatgtatctagggaggttgctcaggatttgagcgaggacgacattcttgcaatgttggcttacttcactgaagataacaatttgatttcaaatgaaaatggtcaaattgagcagtatgataatgtccatgatggaaatattgaagcttcacctcgtttggatggcgttgatatttacnatgacttgggtgaccttgaaaatatggttggattcagtggaggtgaatatgatttcttccctgcagaaaactctaactacaatctggatggagc

SEQ ID NO: 16760 - DNA, 480 bp, Citrus sinensis
  Predicted polypeptide sequence is orthologous to G525
gggggttgcagggcaaatttttcccatgagagacggcaagctaatcctcaggcactttgaatcaaatctgaaaaatgggctatcttgtttttagattattcagattccatccaccagatgaagaagaaatcatcaatcgtttcctgaacaagaagagacttgaccgtgatttctctgtccagccaagtaaaaagcatacagctaaatgtgtcgtgtacggatttcattccacgtacggcctttttcataaggttgaaggtcaacaactacctagtcttgattctgacaatcatgttgcagaaaatattagacaagaggtagaatatgaacaagtaacagatcatattatgacttataacgtagaaatcatgttgcagaaagcgtatgttccagttcatgggaagaattgcaactactaccaagtaaccatttggtttctggttctagaaatcatgttgcagaaaagattgaaaaaaaaaa

SEQ ID NO: 16761 - DNA, 738 bp, Citrus sinensis
  Predicted polypeptide sequence is orthologous to G526
gaggccaattccagggctgccaatgaactcatcttttggtgatgacttttttgctaattatgcttcgcttccaccactaatggatcctcctggttcttcgagcttcggaaatggtggccatcaaaatgagttcaaacccatgaacacagcatccacttcatcaagatcttacaatatccccgcagacaatcaaaatttccttcagcctcatcaaattccaatccaaaatcaaatcttctcctatcaccaaaacaataataacccgaatccaggctacttgcaccagggaacaatacggactagcacgggtgcaatctcgagcttgatgggtgccggctttgagggaaatggtgatgatcaggccattttaagagcgttagcaagcacatctcaccatcatcagcagcataatttggagagcagcagccactgcaaagttgagcagttttcatctaaccaatccatgatcagccgctcacaagacaccggcctcagcactgacatgaacactactaccgaaatttcatctgttgtttcgaagcaagataacaagtcttatgatcaggacctcgatgcgacatctattgctgaattggatagcttttgggactactgatgatacttggaaaattaatttaagtttgcagcagctctcctgttttttcgtaaatttttaggatgtatggtttcaattaagttagctagctagctaattgatgatcacaatttatgtgctat

SEQ ID NO: 16762 - DNA, 873 bp, Citrus sinensis
  Predicted polypeptide sequence is orthologous to G536
gggggaaaacaaaaagcaacaaagctcagagagagagagagagagagagaaggaagagagctagcgagagaaagagtgagtgactgaacgaaatggagaaggagagagagcatcatgtttacttggccagacttgctgagcaagccgagagatacgacgagatggttgaagccatgaagaaagttgccaagttggatgtggaactgactgtggaggagaggaatctggtgtctgttgggtacaagaatgtgattggggcaagaagagcatcatggaggattttgtcttccattgaacagaaggaggaggccaagggtaatgaacaaaatgtgaagaggattaaggaatataggcagagggttgaagatgagcttgcaaagatctgtaatgatatattgtctgtcattgatgaacacctaatcccatcctccacatctggagaatcaaccgtgttttactataagatgaaaggagattattaccgttacctagctgagttcaaaggtgctgatgatcgtaaggaagctgcagatcattcacttaaggcttacgaggctgctacagctgcagcagcctcagagttacccccaactcatccaatcagacttggcctggctcttaacttttctgttttctactatgagattttgaactcacctgagagggcttgccacctggctaaacaagcatttgatgaggcgattgctgaacttgatagccttaatgaagagtcctacaaggacagcacccttattatgcagcttcttcgggataatctcaccttgtggacctcggatctaccggaggagggaggtgagcaatctaaaggtgatgaagttcaagcagagagctagccggggatgcatgagcatc

SEQ ID NO: 16763 - DNA, 880 bp, Citrus sinensis
  Predicted polypeptide sequence is orthologous to G536
gggggttgtaaaggcgaagaaagagagaggaatctattgagactacagtaaaaccctaatctcttcctcggagatcggccatggcttcctctaaagaacgcgaaaacttcgtctacgtcgccaagctcgctgaacaagccgagcgctacgacgagatggtggatgcgatgaaaaatgttgcgaagcttgatgtggaattgacggttgaggagcgcaacttgctctctgttggctacaagaatgtaattggtgctcgaagagcatcatggaggatacttccgtcaattgagcaaaaggaagaagcgaaagggaatgaagtgaatgcgaagcggatcaaggagtataggcaaaaggttgaatctgaattgtcggacatttgcaatgatatcatgactgtcattgatgagcatcttattccttcagcaagtgctggtgaatcaactgtgttcttctataagatgaaaggagattattatcggtaccttgctgaattcaagtttggcgatgagaagaaagaggctgctgcttcaatgaaagcgtatgagacagctaccactgctgcagaggctgatttgccacctacacatcccatccgattgggtttggctctgaatttctctgtcttttattatgagatcatgaattctcctgaaagggcttgccatcctgcaaaacaagcttttgatgaagctatttccgagctggacaccctcaacgaggagtcctacaaagacagcaccttaattatgcagcttcttagggacaaccttaccttatggacttctgacattccagaagatggagaagatgcccagaaggctaatggcactgccaaagttggtgggggagaagatgcagagtgacaaggagagcatcgagg

SEQ ID NO: 16764 - DNA, 830 bp, Citrus sinensis
  Predicted polypeptide sequence is orthologous to G536
gggggctgatctcgcgccgacgcatccgataaggctgggattagctctcaatttctcggtgttttactacgagattctcaatcaatctgataaggcatgcagcatggctaagcaggcatttgaggaagcaattgctgagctagacactttgggagaagaatcctacaaggacagcaccctcattatgcaactcctaagggataacctcactctttggacttcggatgtgcaggaccagttggatgagccatagaaagcactgtgagcttgaccggtcctattcttcttatggaggaggtgggctttgaatgtcattttgtctgttctgtttaaaagtgtgttaattcgaagatgggtatcaaacccatgaaatgatgtttgcatgttcagacttatattgtttttatattttgaaatggtctaaataggttagctcttgatgttaacaccagcaagtcttggtatctaatatttcatgcaatttatggttgatggcatacacttttactgtaggatcaaaaggcattgaaaaaaattgaaaatagaaactagaaatgtgctcaactcgcagatctctctcaggacggaaaccgtggttcttagttgtcagatctgatggaagcgtcaacttaggctcgaatcaaagatcccggaggactcaacagttgatcactaatgcagttgcaacgaaggctgattcggcagcttctacttcggcatcaaagcaagggcacgaacttttactttttgaagctctacgagaaggcttggaagaagaaatggacagagatccacatgtatgtgtcatgggtgaagatgttggtcactat

SEQ ID NO: 16765 - DNA, 866 bp, Citrus sinensis
  Predicted polypeptide sequence is orthologous to G536
ttcccctccagtaactttacagtttctgcaattctgctatgggaaccccgacgagagagcaatacgtttacctggcgaaactcgccgagcaagccgagcgctatgaagagatggttaagttcatggacagcctcgtcacttcctccactccggcgactgaactcaccgtcgaggagcgcaacctcctctccgttgcttacaagaacgtcatcggctctcttcgcgccgcgtggcgtattatctcctctatcgagcagaaagaggaaggccgcaagaacgaggaacacgtctcgctggtcaaagactatcggtcaaaggtagagtctgagttatctgacgtgtgcgggagcatattgaagttgctggactcgcaccttgtgccttcggctactgctggtgagtccaaagtcttctatttgaagatgaagggagattactaccgttacttggcggagtttaaagttggtgatgagaggaaggccgccgctgaaaacactatgttgtcttataaggcggctcaggatattgcactgactgatctggcgccaacacaccctataaggttggggctggcactcaacttctcagtgttttactatgagattctcaattcatcagagaaagcttgtaccatggccaaacaggcctttgaggaggccattgctgagctggacactttgggtgaagaatcctacaaggatagcactcttatcatgcaattgctaagagacaacctcactctgtggacctcagatatgcaggagcagatagatgaggcataagggtatggatcgtttgctcctctggggaggtgggcttttgaatgtcatgaattgtaaagcaagtgtgattttagttgactatgt

SEQ ID NO: 16766 - DNA, 853 bp, Citrus sinensis
  Predicted polypeptide sequence is orthologous to G536
cgaatttgggtaccgcggcccccccttggtcattggtttcattattgtcaagaaaacaacattagagaatagtattcacccattcacccctcgttgaaactaaaaaaattcaatctggaagtaattaattgaaaaactaataaattgcaaaactaattccaatattcataatttgatgcatgaacacctaaagtccataaatgaatggttgtggaccaagcaaacttctccaaacaaaaacaaacagagaagtgaaatactgccgcgaagacaagtgacttcactgcttcttctcttcctcgggcttcggtgcttctttgatctcatcagttccatcatcctgcatgtctgaggtccacaaagtgagattatcacgaagaagctgcattattaaagtgctatccttgtatgaatcttctccgagtgtatccaactctgagatggcttcatcaaaggcctgttttgcaaggttacaggctctatcgggagagttcaaaatctcatagtaaaacacagagaagttcagagccagtcctagccggataggatgagttggcgccagttcagcatttgcaatatcctgagcagatttataggcattaagagtattctcagcggcgactttcctctcatcgccagtcttaaactcggccaagtacctatgataatctcccttcatcttcaaataaaacaccttggaatcggcagcggcagcggcgggaaccaatttctggtccaataatttcaagatcccgccacagatctccgtcaactcggcctcgatcttcgatctgtactccttaatcacggagacatggtcctggttgcctcgcgactcctccttctgctcgat

SEQ ID NO: 16767 - DNA, 867 bp, Citrus sinensis
  Predicted polypeptide sequence is orthologous to G536
taagatttcgatatcttcatgaaaaagaaaaatagtggagcattcaaaacacagaatagaaggggcaaaaaaaaaaaaaaggagtaaagaaaaaagaaaacttagtacattcataattcaataaccaagagaagaatgcctaaatattcaaaagcaggaaaactagcaacaaacatcttctccctttaaaaacagtggagaaagttcaatcccatctgaattctcactgttgttcgctttcaggcttggccgcttctttaatctcgtctgctccatcatcctgcatgtcggaggtccacagagtgaggttgtcacgaagaagttgcatgatcaaagtgctatccttgtaggactcctcacccagggtatccaactcagcaattgcctcgtcaaaagcctgcttggccaaattgcaagcacgatcaggagagttcaggatctcatagtaaaacacagagaagttcagagccagtcctaaacggatgggatgagtcggagccaattctgcatttgcaatatcctgagcggctttataagcagtgagggtgctctcggcggcttccttacgctcggctccggtcttgaactcagccaagtacctgtgataatctcccttcatcttcaaatagaaaaccttggagtcaccagaagaagcggaaggaatgaggcgggagtcaagaagcttcaagatgccgtcgcagatcgaggaaagctcggtctcgatcttggagcggtaatctcggatcgtggagacgtggtcctcgttgccgcggctctcctctttctgttcgatggaggaaataatgcgccagctggcacggcgggcgccgatgacgttcttgtaagcgacggagaggaggttgcgtt

SEQ ID NO: 16768 - DNA, 500 bp, Citrus sinensis
  Predicted polypeptide sequence is orthologous to G536
tttttttttttttttttaaattcaaggggaacttcaaacattaaaaacataaaaggatgtccaaatagcaaaaatccccctggggaatttacagctaaataaaaaaaaccccttgggcaatcaaaccaaataaccccctactaccctccatccatcatgacaggagggaaacaatgggaggcaggacaagtacaaccaatcgggtttggacaaccatgctttaaaggaagccataccacaatatggccctattaaaatgaaaataccgcaagcaaaaaacaatggcactttaagcaaacacaaagtttgattaacaagtcccatcctttcccccccaatcacatagcaaccccccgatgctccccttgtccctctgcatcttcccccccaccaactttgggagggcctttaaccttctgggcatctccatcttctggaatgccaaaagtccaaaaggaaagggtggccccaaaaagctgcataattaaggggctgtcttt

SEQ ID NO: 16769 - DNA, 940 bp, Citrus sinensis
  misc_feature (907)..(907): n is a, c, g, or t
  Predicted polypeptide sequence is orthologous to G536
tcagatcgaatccgtattcccaaaccttaaaacgctaagatgtcgcctactgattcttctcgcgaggaaaatgtgtacatggccaagctggccgagcaggctgaacgttatgaggaaatggttgagttcatggaaaaagttgcaaaaacagttgatgttgaggagctaaccgtggaggaaaggaaccttctctcagttgcttacaagaatgtgattggggccaggagggcttcatggaggatcatctcttcgattgagcagaaggaggagagcaggggaaatgaagaccatgtctcagtaattaaggagtacaggagcaagattgagaatgagctcagcaagatctgtgatgggattcttagcctccttgagtctcatctcattccctctgcctcatcggctgagtctaaggtgttctacctgaagatgaagggtgattaccacaggtatctggctgagttcaagactggagctgagaggaaggaagctgcggagagcactttgttggcctacaagtcagctcaggatattgctttagctgaattggcccctactcacccaataaggctgggacttgcactcaacttctctgttttctactatgaaatccttaactcaccagatcgtgcatgcaatcttgcgaagcaggcttttgatgaggccatttctgagctcgataccttgggtgaagaatcatacaaggacagtacattgattatgcagcttctccgagataatctgacactttggacttctgatatcactgatgatgctggagatgagattaaggaagcagcatcaaaacgtgaatcaggggagacgcagcagtgatgaataatgagttcagttcataggatatgtatctgtattttttatcttgtggcttttattttacatggatgccatngtgggttgttttagcaggatattctcatgaact

SEQ ID NO: 16770 - DNA, 934 bp, Citrus sinensis
  misc_feature (762)..(762): n is a, c, g, or t
  Predicted polypeptide sequence is orthologous to G536
gcttgtaaaagcaaaagattcgccatggacaaagatcgtgaaaacttcgtttacatcgccaagcttgctgaacaagctgaacgatacgacgaaatggttgatgcaatgaaaaaggtagcgaatcttgacgtggaactgactgtggaggagagaaacttactctcggttgggtataagaatgtgattggtgcacgtagagcatcatggaggattctttcgtcgatagagcagaaagaagaggccagagggaatgaacttaatgtgaaaagaattaaagagtataggcaaaaggtggaagctgagctgtcgaagatcagcactgatattatgcaagtcattgatgagcatttgatcccttcctgcaccggaggtgaatccactgtgttttactataaaatgaaaggtgattattatcggtacttggcagagtttaagactggtgatgagaggaaagatgttgctgatctgtcaatgaaagcctatcaggcagcttctactaccgcagaagctgaattgtctcctacccaccccatccgacttggtttggccttgaacttctcagttttttactatgagattatgaactctcctgaaagggcatgccaccttgcaaagcaggcctttgatgaagccatctcagaattggatacattaagtgaggaatcttacaaagacagcacgttgataatgcagctattgagggacaacctcactctttggacttctgacataccagaggatggaggtgatgaagcccagaanatggacatctctgctaaagagggtgaaggtgaagattgaagaagcagaggtgggtttgttttcctattttggagcagagttgcaatctttgttgttttctgtcctcagtgaaccagccaggagcttgggagctctagcatatgatagcaaggaagctgcaatacctttatga

SEQ ID NO: 16771 - DNA, 398 bp, Citrus sinensis
  Predicted polypeptide sequence is orthologous to G536
agactattaccgatatttggctgaatttgctactggtgaacaacgagaccatgctgctaacgaatctctcactgcttataaaaatgctactgatgttgcttctaaggaacttcctcctactcacccaattcgacttggtcttatcctgaacttttctgttttctactacgaaatcttgagccaacctgaaaatgcttgtgctttggctaaacaagcttttgatgaagctattgctgagcttgacaccttgagcgaggaatcttacaaagatagtactctgattatgcaactcctcagagataacttgactttgtggacttctgatcttaacgacggtaacgagaatgaagacgacaatgacaattaaacctttgaaatataaaaaaaaaaaaaaaaaa

SEQ ID NO: 16772 - DNA, 775 bp, Citrus sinensis
  Predicted polypeptide sequence is orthologous to G550
ttttttttcgaatagaagaagttgaatttgattcccatatttattttagcacttatgggaaatttatggtacacaaactcacacttttctacctctcactattttgcatatataaactatgtacatgaactcgcaaacaacctaacctccaacaaaaagggaaaaaagaaaaagaaaaatcggttgccacttcagctaagctctcttctcctaagaagacaatgaaactgttgtaagagttcatttcgaatgaggatggtgaatgtatatgaccttggaaggaagcaaaaatggagagacttgcaaggatcagtgacacttgcactaccaccttaaccagatacaagttgatgacctatctaattacgagctctcttggaaattgagtgatctagataatgctgctggattggcttgtaagaccggagatgttccagcaatgtgaccccttccatcattcttctgttggaatgccttgaagagtcctcctctgccaatggaatcagccttatcattcttaatccctagtgtcgtccatatggagctctttgcagcatctccagggtcatcgatcctcaatgtttttggaacccagagacatctttcggcattgttttctttgtgttgctcctgtccctcagagttgcttgcttttaccaagctctcctcccttgaatgctttcctagtgttggagagtttggagccgagcttggggtttttggagaagttggttgaggaatccaagggatattccaagcgcccggtacagtacaa

SEQ ID NO: 16773 - DNA, 776 bp, Citrus sinensis
  Predicted polypeptide sequence is orthologous to G557
cctttttggagaagacaagtctttaatttcatcatcggttaatctttactactgcaagacggacaattctttaacttcgtcatggattaatcttgctacatactgattgacatttgctacaattatggaacaaacaggcaaggcagctgccatagaaacattacaacgcgataatttataggctaagcttgccaaggcttacaggtctattttcacgttagaggtaactttcaaccagcaaattgccggttctatttttcataaaaagtaactctctcagtaagaatattccttcttttcttattctattaaaaggacccatcggcatttgtatcaccgccgcttcctcctcttcggctcgccgtggtgttcttcagtatgtgtctcagcatctgattctcattttgcaacgtggagagcctctcatcgagctcggaattcttcctctccaagtctttaactctcgtctccaactcattcaagtacgcctttttcctctctcttgcttgctgagctgacactctgttcctcaacaacctcttcaatctcttgttttctttgtcagctgggcttctgcctctcttcctctgaccttctcctaactgctgtactcggtcaggaccgcccgtcgaaacgagttctcttccggaagctgacgttcccccgggttcgccgccgatctctgggactcttctgatctcttcatcgctctccataccttctttgacttcgagatgaagagcagagcttgaagatcgctcgctgctagacggcaa

SEQ ID NO: 16774 - DNA, 546 bp, Citrus sinensis
  Predicted polypeptide sequence is orthologous to G558, G578, G629, G1198, G1806
tttttttttttttttttcttagaaaaaaaaacttaataactttatctcatcaaacattcaaattcatttgagaaacattggttacaatgacaacagacactggaataacacttacaacttacaagagtcccagagaagataacgattatgcggcgaataataaacagaaatacatatccatttcagagaataatggacaaattctaccagtacgacctattaacagaaaaaccagtaccaacactaaagtataaaaatctaggacataagaaaatctaaacagataaaggggggaaaaattgtcacaactacagaacaattatctttttcaggatgtaattcagattccttccccccccccctctcaaggtgcataatttcacaaatctacctggcaaaaaacacaatgcatcttcactctcttgggcgggccatccagagggaactaagagcacgtagtcgggagaaataatcatggattgcaaggagtgcacgagcagactggcgcgttgtcaatattcggtgcatttgttgtaatgtttcctc

SEQ ID NO: 16775 - DNA, 678 bp, Citrus sinensis
  Predicted polypeptide sequence is orthologous to G558, G578, G629, G1198, G1806
gtggaaaacacctgttgagaggtgtttcatgtggttgggcggatttcgttcatctgaactccttaaggtaatcggtaaccatctggaacctttgacagatcagcagttgatgggcatttgtaacctacagcaatcatctcaacaggctgaagatgccttatcccaaggaatggaagctttacagcaatctcttgtagacacactttcagcttcttctcttggccctactagttctgggaatgttgccgactacatgggccaaatggcacttgcaatgggcaagcttgccacattagaaaattttatccaccaggctgaccttttgaggcagcaaacacttcaacaaatgcatagaattttaactgcccgtcaagccgcccgcgcccttctagtaataaatgactacacttcacgccttcgagcactcagctctctgtggttggctcgtcctagagggtagggactgacaatatcactttcgctggaattcatcagtgcttgtaacagaaaagttctgctatttcacctaaattttggatccattgaaaatgttgggaccataagtggtgaggtgtcatgttagtcactcttggatagcccagatattgttgttacttttgtatttattgctgcgttttaccagatgccagtgttaagaagtaaaaaaaaaaaaaaaaa

SEQ ID NO: 16776 - DNA, 836 bp, Citrus sinensis
  Predicted polypeptide sequence is orthologous to G558, G578, G629, G1198, G1806
gactttttaatggtctgccgatatgttctgtgagatctgtgagatccaaggaaagcatttaaagtcttgctgcaacatcaaagttgcttgttcataattatattggatcaaaatctctgctgcatgagcttaatatactgtgcagcagcatttgatgtagaatattctcgctggcttgaagagcacaacaggcatatagttgagctaagggctgcagtcaattcacatgcaggggacactgaactccgtactatcgttgacaacgttacatcacactttgatgaaattttcaggcttaaaggcattgcttcaaaggctgatgtcttccacatcttgtcaggaatgtggaagacaccagcagaaaggtgttttatgtggattggtgggtttcggtcatctgagctccttaagcttcttgtgaatcagttggagcctttaaccgagcagcagttggtaggcatctataatttgcagcagtcatcccaacaggcagaagatgctctgtcacaagggatggatgcattgcagcaatctctggctgagacattggccaatgggtcacccagcccatcgggaacatctgggaatgttgcaaactacatgggtcaaatggccatggcaatgggaaagctaggaactcttgaagggtttcttcggcaggctgataatctacgtcagcaaactctacaacagatgcatcgtatattgaccacccgacaatcagctcgtgcgttgctcgcaataaatgattacttctctaggcttagagccctcagttctctctggctggcccggccacgggagtgagagacagttcctcttcaaaaagttattct

SEQ ID NO: 16777 - DNA, 914 bp, Citrus sinensis
  Predicted polypeptide sequence is orthologous to G559
cttttactgagaaccaacatgtaataaaagaatcgtactagctataaaagccagccacagcccactgaaaggaaacttcaacatagcgacctaagactgtaagataggagcaacctaccaaatttgaattaacaaatcacatgcagagacccacaggtgcaaaaaagtctctaaataagccatatcatgtaatatatatctcccataatccaatctccatctaaaatccaataactgcctagaaataagctatagatgtatctaaaaacactaaaggaacatggcaaaatgagcctatctgacaactgaaactgggattctggtaacaactgctcgattcattcctcaatcctttgatatagacgggttgacatctgaagtattctctttctggttgggagaaggcactgatcctctcattttaatttccccagtttgttgttgctgttcctgctgctgctgttgcagttgttgctgctgcatctgatgcaattggtgctgctggaactgctgctgctgcttctgcgagtgaatttgaagctgctggaactgctgcgcggttagaagagtatgcatagcttgattgtttgggtaaaattgctgaccagctccaaaagacggatagttcatcattggtccaccattaggcattgcttggccagtcaataccttcagatgctgaatctcctccttcagtgcatcatttagtgcatcttgcaagtggacttgttgctccatcgtttgcaaacgcagtttcaattcactattttcagcagtcagaccattagtatctctctgcaataatgtcaattgagcagacaatgaggttgcttcagtttgtaatgtctgtactttacgttcaagctcagctatgtatcgcatcttcctttcctttgacctggcagctgactgcc

SEQ ID NO: 16778 - DNA, 802 bp, Citrus sinensis
  Predicted polypeptide sequence is orthologous to G567
atgcaacatttatattgatcactgtcaatacttacaactgaaagtcaatccgactattatttgtttcccaaaatcccagcctaaaatgactattttcttctctaatgtgcagagaagattaatttgaaaagaaaagagaaaaaaaaaaaaaaaggtgcagtgcagggcatagtttattgataaatttagaccaattggtgtgttgtaaccatttttaggatgaagacaacaaggaagactgatttattctacctctgcttgttattctttgatcctgcatgcggaagtccagtgtcccagccaggcacagccccaggtggactgactctatggcctaccccctgtggcacatgctctaagccaacggcatgctgcaagggagatgtttcagtcatgtttttgccccctctatcactttgaggatttccaacagtaggaagctggatattactagggaaactgctgtccaagctctggtgatttggggtgggagtactaatacttggaattgcttggtgaaagaactggtttgggtttggttgcattggatgagtagcatttctagacgcatcgagtgggacgttgactaatggcatgccaacacctggcacatcggatctggctaaaagcaggggattcaacccagtcactcgcttaactgtttcttcagccattttcacctttgctcttaatgtctcaatatcagctttcaatattctgttattgacagcagattcatcatattttctggttcacgtcggtcagaccttttagtaacgaagaatgttcagctcgtaattga

SEQ ID NO: 16779 - DNA, 842 bp, Citrus sinensis
  Predicted polypeptide sequence is orthologous to G583
cctttttttaatcaattcacatgataattataagctgctacaaaacaaaaggcagtataatctgaaaaacggaaaaaggacagaacaaaaaaaaaaaaacggatgcagttaataagcaagatcgagtagtaagctaaactagttttgcattctttggaaaatagcacttctaataacctcttcactaatcaatccctcgggaatcctgacgacaacatcctgaagcatagtctccctcacgcttgatacactggcatgatgaacatgaaactcaagatctctgagcacatccatcaatttagctgccggataattgatatctgggcattgaacacgtatcatggcttctgatcctacaatcttcacatcgacatccataatattaatattaatgccaagatgatgagtagtcgaagacgacgttggcatcatgattgtagagccagtgctttgattgttgtcataaacgttgtacaccacctttgattttctagcctgttcacggagtttcgcctcaagttcgtcaaccttggccctgagctctttgatgtaggcaacagcatcagcgagtaaagaagctttgtccattttggaaacgtttggaaccacagagcggagagcatagaagcgatgattaagcctctcacggcgctgcctctctgcttccacgtggttgagaggagactctcttccgcttgttggctttcttcctcgttttttggatgtaacattaatgtcagtaaatcctgaaacgaagtgaccgtctgagtcagaaggccccgaatctgaagatgaacggccaaaaccagcagctaattgttctttcttattacatcgccgga

SEQ ID NO: 16780 - DNA, 765 bp, Citrus sinensis
  misc_feature (762)..(762): n is a, c, g, or t
  Predicted polypeptide sequence is orthologous to G585
gggacaaccaaattttgttgacagaatacaactggagcttcttttctgtgaaggctttgcttcttgtttgttgaccattttgtctgttgatgggctttctttccggttatctaagttgaatttactgatttttgtgcttgacaatggctagtgctgctcaaaaccaggagggggtgccagaaatcttaagaaaacagcttgctgttgctgttaggagtatccaatggagctatgcaattttctggtcattatcagctgcacaacaaggggttctagagtggggtgatgggtactataatggagacatcaagactaggaagacaatgcaagcaatggaacttacacctgataaaataggtttacaaaggagtaagcaactaagagagctttacgagtctttgctgaaaggagaatctgagctggcttataagaggccttctgctgcattgtctccagaagatcttactgatgcagagtggtattacttggtttgcatgtcctttgtattcagttctggccaaggtttgccaggaagagcacttgcaaacagtgaaacaatctggttatgcaatgctcagtgtgcagatagtaaagtattctctcgctctttattggccaagagtgcatctattcagactgtcatatgctttcctcatcttgatggtgtaattgaacttggagtcactgaactggtcccagaggatcctagtctcccttcacatatcaaagcctcattattagacttctcaaagcctttttgcnctg

SEQ ID NO: 16781 - DNA, 865 bp, Citrus sinensis
  Predicted polypeptide sequence is orthologous to G590
tttttttttttctgaaatagatttttatataagttaaacagatgtcaacagttcaaactgttgtggcttgcgacataagaaagctgattaactgtgaaacgtcagcaatttttaggattatttgcagtttctatggtgtttgaccaattgcaactctttaagaaggtggctattgtgtcatacgctacatctttgaggataaagatcttggctacgacacgccagatgagttctttccattgaaattcatatccaaatgcagatgaggtgcaccttcactgcagatttccttggaagaagaggggagagtgaagggtccatagtgagcctgaatcagtggttcaagtccaaatgcagtttctgatgtgctaatatttgctgctgaaggtaaggcaactggctgatcagagatggtacattggctggaaagattaaaaccagtttgcaccgagctttcttcatttgcagaaaatgtttcggttcctccatcggtattcaacagtccattaccctcatcaaataccattcccatctgaggcagttgcatagatggtagtactcctggtaaccacattgggtgcaaactcaatccatttctcattgttaacatctgtacttggagttgaagctgcttgagatattcgatagcctcatccagcattgaagctttgtcagtcttgttagaattgggaattaggttctgtagagctttcagtttctcattaattctactcctccgcctcttccaaacaataaaccatacacatcaacaaagtccatgaacaaataaataaagtaaaaattccacttttaaaagtacaaaggggaaaaaagaaaattcaagcttgaagggaaaccttttctg

SEQ ID NO: 16782 - DNA, 444 bp, Citrus sinensis
  Predicted polypeptide sequence is orthologous to G592
ggctgtgcgacccatcccagaagcattgccgaacgggtgagaagaaccaaaattagctgagcgcatgaggaagctacaagaacttgtacccaacatggacaaacaaacaaacacagcagacatgctagatttggccgttgattacgttaaagaacttcaatgccaagtgaaggcactctcggataatcgtgcaaagtgtacatgcgcaaagcaagagcagcaatagaagaaaaggcctgggattatgtacagaagcgaaaaagagctgggaaaaggaagatataaagcttggttgtgggttcttttttgcactaaaaaatatgaagatggtagtgattagtatttagtgagctagctatttatttctattatatactatgctgtggggtgtggagaaaaattataaaaaaaaaaaaaaaaaaaaaaaaaaaaaaaaaacctcgg

SEQ ID NO: 16783 - DNA, 877 bp, Citrus sinensis
  Predicted polypeptide sequence is orthologous to G592
ttttggatgaagaagcttaatacaattaatctacgtgaagagaatcaaagcaagacaatcactctactcaactggatcttacaataaattacaacagcaatcttttcaacccgctaaatctcactcgctatcctattatttttttaagggcagtggaaatgaggagtcatctttctttttcatctcacaagtagcagcttccttaagctatctgtacagatacaagtctaccggaagtttttgtaattcaacatagcttttgtttgtttgggcacatgcattttgccttattgtccgtgagtaacttgacttgtttctgaagatctttaatgtgttcaactgccagatctaacatttcagctgtgtttgtttgcttgtccatgtttgggaaaaggtcttgcaatttcctcattcgttcacttatccgagttcttctaaccctctcggcaatgcttcttggatgagtggcacaacctctcttggctcgaatcttgcaaggaacagaaccttgaaaatgcaaaaacttctccacagcagccatttcagcagatgtttttggtaagctcaaatggtggaccaagcgagtagattggtttccagaatttccattctgagtttcatatgcgtctagaccaaaagacatgttgcaagtactgtctctagccctcttaacaccactgaatgaagcatcatcccaaggatcgcttggaaaattgggcatgtattgtctactggcaccattattgcccacaaagtttttctctgggctactattccccatgctttggttcccagtttcagcaatctgaggcataaatcttgaagatgacccaggtgacaagttaacacgattgattagcctactagccgatgtgct

SEQ ID NO: 16784 - DNA, 759 bp, Citrus sinensis
  Predicted polypeptide sequence is orthologous to G597
tgtgagagaagttcaatcaaagtagctgaagtctcgaagaagatgtcaggatccgagacagcagtgaatgtgatgacgtcacagcctccggcgtcgatacagagcatgcgtttagcgtttagtgcggacggcacagctgtgtacaagcccataactgctacgtcgccaacttaccagccatccggagccggcggagacggggccattccacaggcacagggacttaatgtgatgaacatgggcagtggaagtgagccgatgaagagaaagagagggaggcctagaaagtatgggcccgatggcaccatgtcattggctcttgttccttctccttcttctgttaccaccgccaccggtggtactggtagtgggttatcttctcccggtggcggtccgttgtctccggattctataaagaaatctagaggcaggcctcctggttctggttctggaaagaaacaccaacttgaagctctgggttccgcaggggttggatttactccacatgttatcactgtaaaagctggagaggatgtatcatcaaaaataatgtcattttctcagaatggtcccagggctgtttgcatcctctcagctaatggagccatatctaacgtcactctccgccaagctgcaacatctggtggaactgtaacttatgaggggagatttgagattctttcactttctggttcatttttactatctgaaagtagcggtcagcggagcagaactgggggactaagtgtctcattatct

SEQ ID NO: 16785 - DNA, 684 bp, Citrus sinensis
  Predicted polypeptide sequence is orthologous to G597
tttttttttttttttttcaggagaggtacattaaaatcaggacggtcgtcaaataataatgatgatcctacagcattcctaaaatttgaaagctgcaattgtttctaaattctaatactgacactggggcagcaacctttggaacttatgttaataaaactaattgttacaacagaaatgtaaataagattagttcattcagttgtcaagtcagcttccaaacctccaaatgaatctgcaaaggaaaaatgttgttaccttgcaggcattgttttttgaagcattctatatttgatcgaataagtaatgcagcaaaattccatcttattcgtttggcaaagaaacattgatatcaggagatggcctctgactagttgtggtttcagagccgttccaacctgcgctttgagaagttgtggggttaggtacttgtttactgttttcagcattttctacttcagcttggctttgtcttggcactggagttataggagtcaaagaggtctccttctctgggtttacttgagaaataggtcgtgccgctgctaatgtctcaggagcaccacctggggacatgaaaggcatcgtctgctctcgatggtgcttccttttatgcaccttgaagccattgggcatgaaacttcctaccacaatctggatagggctggcagccattaataaacc

SEQ ID NO: 16786 - DNA, 853 bp, Citrus sinensis
  Predicted polypeptide sequence is orthologous to G600
catcttggtggagccttcgacgatcatcggtttgcggaggacgacgatcgttggaaggggtcttctgagataggttccgtccagattgcttctgatcaggaagacggacctcaacggcacccatttgggtttcttcttccatggtagctgcgttgggagtgggctttgaagctagcctgagaacttgatggaggctttgaaggagatgatgaagataagggaatagtcccgtccttggtcctcctttccattcgcgccactctatcaaagagtttgacgaacgtagtcggattgccataagccacggcagtctttagcggtccggtcatgtgttctatgaccatttcgacggcttcggtatcggtaagaattcccccaccgggctccgtttgggctttcccatctcgttccccttaaattgcacgagataaggaaaacgggatatcaagcgggaaggctgtgagggttcagtcaagtcaaagtagtcgcaggaagcataggaagcagcagtaagagcaagagcagtccgtaaagaagtgaagcctttgaatgttgaatgggaactgggaaatgaactgctactggcggatccttgcctagaaccgaagcctttagctagccgaccttgtaccataagtctatactggcatttctttcaataggtcaagcaagtctgctatcatgtgggctattggcttattcatccctgttcgggcaagctattgattccattaccgggccaacaagacctaaaagcccttagttctacctaccacccaccctttcacactgtttaaggggcagcatccattgagagtggattgacggtgttgagagatttccagcataagca

SEQ ID NO: 16787 - DNA, 805 bp, Citrus sinensis
  Predicted polypeptide sequence is orthologous to G602
ggggcccactgagggaacagagccatattgcacattattgaaagaaaatattgagaagctaatcgctttgtcgtagtgagctgtatacgcgaagtctctgtagacgataatggcagaggagcaagtgaagaaagtagaagctgagacgccagcggccccagctccagctccagctcttgctccagctccggctccggctgtccccaacaacgacgtcgcggaggagaaagctgttactcaattacatgatcaagagaagcctgttgatgactccaaagctctcgcagtagttgatcaaactccagattcggccaaaaagaaaatttctggggaaaagaaaatttctggatcgcatgatagagatgttgctcttgcagaggtcgaaaaggaaaagagagagtcttttatcaaggcatgggaagagagtgaaaaaacaaaagcagagaataaggctcagaaaaagctctcagctgttgctgcatgggaaaatagcaagaaagcatctctagaagccaaactgaaaaagattgaggaacaactggagcggaagaaggcagagtatgctgaaaaaatgaaaaataaggtagctctagttcacaaggaagcagaagagaaaagggcaatggttgaagctagacggggagaagacgttcttaaggctgaggagatagctgcaaaatatcgggctactgggaccactccaaagaagctcctcggttgcttctgaaatcaaattgtttttgcaagtggtatattttttgtgtttatgattatgactcccaactttatatctgtatactttctt

SEQ ID NO: 16788 - DNA, 831 bp, Citrus sinensis
  Predicted polypeptide sequence is orthologous to G605, G1944
gagggggaaggaaaaaaccggcctacggtgaaaatcgggtaaactttttcttgagaaatatttttctcaagaaacaaacaaagaaaattattttctttgctttttattttttgtaaccgaactgtgatttttggagatttcacttgagagaagcttctgaactacactgtttgagctctgcaaatgtgaaaaaggtctgagacagacagtttcagttgaggtgaggtctggccgttatgctgatatgagtagtcagagttggcgaaaattggatttttgaataactattaatcaatggaagcaggagaaggcatgagcacaggagttacagtgataggagctgaagcaccatcagcctatcacgtggctccaagaaccgaaaatccaacccaggtatcaggatctctggcggtgaccacgtcccctgttagtgtaggattgactggcacccaagaaaagaagaagagaggtagaccgaggaagtatggtcccgacgggactatggcattgtcacccatgcctatttcgtcctcagttccgccttctggtgattttccttctgggaagcgaggaagaggacgggttagcggtcatgaaagtaagcactacaagaaaatgggaatggacaatttaggtagtgtcggtatcaagctgtctctctagctgcatttgttgcattttggcactgttttagctagctctgaattactgaaatggatatatcataatactgtgaacatgcaaggttatatatttgatgagagtgaaatgattttgttttgttgaatatttattggtattttctgcatttgactgttgctaatttcttat

SEQ ID NO: 16789 - DNA, 875 bp, Citrus sinensis
  Predicted polypeptide sequence is orthologous to G620, G1821
ttttttcagtacaattttttttttgttgtcagaatgaaaaagaagagaaaagaaaaacagttaaaaacaccaaacttattctctcactaacaagaaactgagcaggtggttatttggtcacattaattagcaggtctaggtagagataggttagtgcggcttgcgtttcatctatctgatcagcactgtcttatttgttgtgagcataagtttcaccattagcaacggcaggctgtgatgaccccgccgcagtattattattggaaggatcgttgttgttgaagtaagtccccgtggcagcagcagcagttgcagctccaagaaagccatgtccacgtcccagtcccatatggtggaaagctgctgctggggccgcaaatgctgcaacacccagtgtacgaaactcaaccggcggcctcttgaccaacggcggctcgcccctgattgaaccccgctccccttccatttcacggtagcggtggaggtaaacagtgagcggctcgatgtaatcatcgaagcccagcttgctcatcgcccaaagcacgtcctcagcggtaatggtcttgcgttgctcgcgctggcagcgctcgttggcttcgccggttatgaagctgatgtactccgacacgcattcttgaattgtttccttcgcgtcgtctgagattttggcatgctggggaaggattttgcgcatgattcttataacgttagcaattggcatgaaacggtcttgttcccgcactgtgcattcgttgtcttcataatttgtgtggttattattattggtttgattaatctcatgagccgatgctagtctgatattcgtctctgtgaacttcagccctggcccacggcttgcgttggggagctgctgg

SEQ ID NO: 16790 - DNA, 820 bp, Citrus sinensis
  Predicted polypeptide sequence is orthologous to G635
tttttttttttttttttagaggaaaatagaaaattaaaattaaaattaaatgccactcccgggatttgtttcccactctctactcttcttttgttggcctagtttccaatttacacaagggtactaaactacgaaatttaacttaatccacctcttgtatatcatcagattggccaattcacggaggcctcccgctttttgaacctagaccaatttttcattagtcattctgctctcttttgtcatggagcttccttatgacgaagccatgatgggataaaaatgtcgccaacaacccaggctttttaatttgaagcaagtgtgtccttggacactcttcccaggaattcaatgctcactgttcttaccttcttcaatcatttcgttgccatcgcctctgagtcagagtccgagaaaattttattcatttcctcaaagtatggccaacttttttggctattcccactcttgctttcctcgtatttctgaagcaaagatgaccaccgggatttgcactggcttggagttcgattaaatccctcatttgctaaatgtgttgatatttctttccagagggccattcttccctttacaacttggaatttgctatgcaattccccacgcattttaatgagtttcttcacctcctcaggtctccatttattccgtctgacacccttcgaaggctttggttgagaacttgacctctccaaggagtcattgtcgctgatttcagtaccatcttcctcaagctccgacatctgttgttcctcttgcgggatcaaaacattgttaccttttaccagactattaattggcg

SEQ ID NO: 16791 - DNA, 754 bp, Citrus sinensis
  Predicted polypeptide sequence is orthologous to G636
gcggttacagctcaagtgctctgctagcaagctcctccagcgactgctaacgcaatcgccgtggcatcaattggaggagctcaagacggtggtgctgctgcttctgatgtcggtggtggtggctcgaataattcagctactgaagaagataaagcgggacgaaacgatgacggtgaccgtagttttggtggtaaccggtggcctagacaagaaactttggccttgttgaagatacgttctgatatggatcaagtgtttagagactccagtctcaaaggtccattatgggaagagatttccaggaaactagctgagcttggttataatcgaagtgccaagaaatgcaaagagaaattcgagaacgtctacaaataccacaggagaacaaaagatggccgcacgggaaagccagaaggcaagcattacaagttttttgatcaattagaagcccttgatcatcatcatcatcatcattcaatcgctcctcaagcaacaacaaaacctcaagctccgttaatgcaagcaattccatggactatgaatcctccgagttcagtcccggctcatatcaagaatgttgttacatcaatatcagccgcaaaccctatacaagccgtgcctcagagcactgtcattgcccctcccacaaaccctacggtttctgcagcagcagcgccgccattagcccagcctgtgaataacttaccgtattcgtttgcaaatgtgtcgccgaatcttttctcgagttcaacat

SEQ ID NO: 16792 - DNA, 837 bp, Citrus sinensis
  Predicted polypeptide sequence is orthologous to G636
ttttttttttttactctccacctaacttcatgcatattacaatcttggccagcatcttaattcatcaagttcgaacacaccctcctgaaaaatttaaaaattaaaataaacattacccctcgtcttttaaccgcaatgaaaaattttcacagaaatgaattcacagttttgtgatttgtaacgtctttgtctcatcttcactcactcggcattccccattgaggcagcagctgctgctgcagctttgtttggtacaatctcataaccttcattgccttcttcttcttcttcttcttcgtcaccctcttcactgtttccttcttcttcttcttcttcttcttcgtcatcttcttgaatttgattcacattcaatggcggctggttttgtccctgcagatgatcattattgtgtagtggccattgctgctccggtagcaccatcaacggcgccgtgttatgattcacagccttcacatttccataacaacctgaattattttcactactcttattgcttttctctctatacaaagcatcaagttgatcaaaatacggacacgtcttcgaatcatcaggccttttcttgttgctctctttaactttcttgaaatacttgttaatattctcccatttctctttacacctcttagcgtttcgattgtatccaacactccgcattgccgctgcgatctcttcccatagaggccctttcggtccattttcttgatacttatttgccagctcggtcctaaatttgatcaaagcttgaacttcagcttttggccatcttgaagagcttgttgacataacaacatttccaccataattattattatt

SEQ ID NO: 16793 - DNA, 819 bp, Citrus sinensis
  Predicted polypeptide sequence is orthologous to G636
ttttttttttttttattaaaggaaaaatgaaggattaagtgatgccaatcggacccacgacacacgacatattaaaagctaagcgaactgacttttaactttttgaaaagaacttccactatttgtgtctcatcaacccgtgattgccactgatgaaggattagtggcaacaagttgataatcatctccctcattatcctcattatcttcgttatctccttcttgactacgattagcattttcgttttcaccattctctgtcagtgattcgacttcttgttgctgtccttgcgcgctcatcatgtgcattagaagttcctcaggcttcaactcgtatgctggattaacgggattatcaaccttcttggcagtcttctctttgtatagagcatcaagctgatgaaaatatgggcatgttttagcatcctcgggcctcttcttattgctttctttgaccttcttgaagtatttgttcatgttttcccatttctctttacaccgcttagcactccgatcataaccaagctttttcatggctgctgatatgtcctcccacagcggcccttttggcccagattcatgataatgtccatcaagattagaccttagccttatcaaggcctcaacttcatctttaggccaccgagatgagcctatatgattaaaactctcacagccattacagttttcttgcctctcaacagccttctccactgaaattggagttgcagaaagttgaaccggacaaggttggtccgaaaacttttgcaaaaatgccagcactgcagcatccttagctgccgcaatggatctttcttg

SEQ ID NO: 16794 - DNA, 828 bp, Citrus sinensis
  Predicted polypeptide sequence is orthologous to G643
ttttttttttttttgaagatcagccagcattgcgctgaataaaatgaactgaaaagcaacaaatgcatccaattccggatttggcttcaaagatgccaacatgaccgaactagctagctaccctttcttaaatcctaatgacatccacaactaattatttacattcttgtacatgatcagtgaactgattgagcgtgttaacaatttctcctagacatgcaatgagcttatccccttgacgcctaacaaattctgattcgagatcctgaacattattcaaatcagcatcactataatcagcactctcagcaactatggcatggattaattctgcattttcttgcagttttgccaccatcatttgctcattttcttctacacagctcttcaaggacttcttctcttttatgcgactgttctgacacttcttttctaccagccgtatccgaggttcttcttccacatggctattgcagagtttttcttctgtgcagccacttttctgatggttttcatgcaagcagctttttagaggcttttgttccgcgcaatgcttcacacgcattgactgcctcctttgcctcttggatcccagttgtgcttgtgaaattgcttcggagaagtcagcttcaggatcggtatctgaatctgggtcagtatcatcagatcggttatccttagacataacgaaatcatgaatggctttaaagagctcactgtcaaaattgggtggaaagcaatcagtatgagtttgagtttgggaattaggaaaagtccttgatcgcacaatcatctttttgtactcatcaagcaatgaatcccatttcc

SEQ ID NO: 16795 - DNA, 819 bp, Citrus sinensis
  Predicted polypeptide sequence is orthologous to G651
cctttttttttttttttataagcagaaacttgtctgtacactctagaaattttattggaaaaaaaccatggcaggatgaagaaggtcagttggagattaaactgacaagcgcctcgtgcttgtggctgctactgatccaccattgttgcaaccccagatgagcattgctgtcttcctcgtcaggagcaggcagattaaggtcaagaaagttgcggatttccggtatcggattctcaagtactatggcgggactgttcctagcttcattgccaccaagtagatgtgatcttttatgaccacctagtgcttggcctgatgggaaaactttgaggcaaattggacattcgtgctttttctttgccccacaacttgtctcagctctatgatcatcacaatcagcaacaaagaaatgatcagcagaattctcattgttaatggatttgattagcttactgtctgctgttgggtcaggcgaatgctcagcttcaatgctattttcactgctgtcaattttggtagcaaaacagcctttgatctttttatggctagctctgtgaccaccaagagcttggtatgagtgaaagatcttgttgcaagtggcacactcaaatttgcttctcttttgagaatccttgtagaattcagcatcagaagcatcagttgttgatcttttcaaagaatctgacctcaattcaggatcaaacgaattgcaaacatttttcttgcttgtcgaattctgcttactagaacccaattcagcttgatctaattctgtgtccttcttcaagttttttatcactttagctttctcaaaatcca

SEQ ID NO: 16796 - DNA, 860 bp, Citrus sinensis
  misc_feature (10)..(12): n is a, c, g, or t
  Predicted polypeptide sequence is orthologous to G653
ggggattgtnnntggaactttttggtgttgatttacttttatggtatggttaagtgattattagctgctactaaatgctgctccttagatctctgttttcgcttactttattgttgataaacatgctgcaggcactgtgcatagagtggtttgatttttgccagccatcatccattgcttgtgaatttggcgacattacttacttggctcacacttcacgatcatgacggacaacgtagagacgagctaacatgggttctctccaacgtcttggcgcactcaatcgccaacggtccgcattcaccaagaaggggctcatgtacatgagtgcgaaaataaacggccagtccgtttgcgcactgcaatggccaaccctccaaacccagcagaagagggtgttgttggtgtgtatgttccaccggagccatcccgcagtcgtgaagacggacgcactcaaggctttctagctaaatctagcacaattcaagcttgtacatatgtagaattctctacacatttctagtacatgtaaatatctagatatttaggcaagttggtagaattctctataaccctaaagcttggcgagcctccctataaatagggcatgacatttggcatttgatcctttgagattctatgagaagaaagcgtgactcaatatatgcccttgtagtttcgaacgggccttacgacatttctcgatccaaaggaatatcatttcaagccgtctgctttcaatgtgactattgccagaatgttaagaaagtcgggaacttcttttggctgtatcatggatatcaagagttctccagctgctcacccactacggacacaaaggatgaattagatggaaactt

SEQ ID NO: 16797 - DNA, 848 bp, Citrus sinensis
  Predicted polypeptide sequence is orthologous to G653
tttttttttaaagatcattgccagaaaatggtcaatttacgaccacgggactctgtatcccataaatcagtatctctaatcaaatgaaatttgtcccaacaatgatgatccaaagaagcagagggaactgaaggtttggtagttcccctaaaaaacaacaagagggatccaaatagaaagcacacccacaagtcggagaaaacccacaccaaataagatttaaatagaaggaagaataacatgttcaagcttctggaacagaggctgctgcacgcttcattgaagcggatttgataaggtggttgtagcttcctttttccttgaacaattgggagaaatgatgtttgcaatacaagatgccttccagggctgcataatttgatgggctaatggaacaaccaccatgcgagcacttgaaacatgtcttgtgataggcctggttttccactgctaccttctccaacggatacactgttttactgcaagaagcacatttttcttgggtcccagagaacatgctggcagctttgctaggcgaccttgtcagctcaggagttaacttctcagctgactttgcaggtgactggaaattcttgttgaagttacccgactccttgaaaagctgctcaaagtgaggcttacagtaaagaacaccttccatggatgagtaattgctcagcttgagtgtgcctttgcagtgagagcacttgaagcaagacttgtgataaacaatcccatcagcagataattgctcaactggataaactgtcttctcacagaccttgcatttctgttgggtaccaataaaagacattgcttttagatctttgggaaagaaaaaaaaaaat

SEQ ID NO: 16798 - DNA, 864 bp, Citrus sinensis
  Predicted polypeptide sequence is orthologous to G670
tttttttttttttttttgaaaagaatcaatctttttgattggatttacacataaagttgaaagcacagaagcagaaaaaaaagtactcatcacaggcaagccttattagcataagcttactgatttgttcaaatacaaatatggattaacaaaataaagaggaagatttgtattagacacatttacaaattcaaaagaaaaattctatgctttaatagcacacacgcctgtgactccgaagacacatttttcccccccaatccgcaataaagttaaaaaactttgtgtaatatctctcttccttttgattctacaagctaaagggtttgtccaaaagccacagaaagtctttgtaagtcctttgtatacattgctggtgtagtttgtgaagcttgttgatgctggttttgaatcccagtggtggtgtttgagccttctgatataaaatgtgcttctggtttaacatcactgtacatagactgagaggtttgatgattttgtattgtgcttccaagaaagaatggagtgttgaggtactcagaccatttgatatcttcttgatcgccttctaatgcgcgaatttgagcttcttgatcattagatttgccacaatctgcagttattccccaagagaagacgttgccttcaaagaagctactgctgctctgcagttcaatacttgttgtgcttccattgctggtgctgcaattgttgctaaagctactaggttcccagttttgtattccattgatgtcactagtgcctacagaaggattctcggaaggaagactaatagaaggctttacgcgaattggagtttggaagactgatgccgaaatagaagggattatgctggaattaaac

SEQ ID NO: 16799 - DNA, 425 bp, Citrus sinensis
  Predicted polypeptide sequence is orthologous to G707
ttttttttttttttaatcaaaaagaacaaataaatcataaatctgcaaagcctagaagatggcctttctataaatcttaaaaaacaacaaaaatactacctgcccacaccaatgcaagtctaggatgtgagctaaacagcaacgacgtttcagcacccaagtcaaaagtctaggctaatgtcaaatacttctctatctgaatcaaacttaagcgactaattgctacaaggaaatataacaagctaaaagaaattgattcacaaatctatctagatcatcaaactaaaaaaaacaataacaactccaaagaagagatttctacagtctacataacacaacaagctaaactggaaaataaaactagagccacataatagaataccaagcactagttgaaagcaatctatttttgtctatgccataca

SEQ ID NO: 16800 - DNA, 933 bp, Citrus sinensis
  Predicted polypeptide sequence is orthologous to G715, G1646
ttttaatcagaatatttagagggaaaaagaaaacagatgattcacaaatccagaactgcacattagatataattaggcaagtcactgcagctacagtttttgctgcatgaaatcaagttaaaaagtcccaacgagttccgattaaagtcatcacatttagaactggttttcctaaacattacagacaagtgttctcataaatcagatgcaagcaaaattccatgtagcatcggcaggggttccaatgcctttctactgcatcacacagcagcataacatctgcatattagttgtttttgtttaacctagccttgaccatcaagattggcaggtcccccgctcccaccactgccataagagccgtcgtccccagtccccgcgggcgtctgccaaacggactgccaagcctgactaggcggctgcacgtaaacaccagtaggatcgacagccggccggccaatcatcatcccaccggggccagcagtcccagtgggctgccccattggaggataataatacggaaccccactggcagtggcccccaccatgccgcccaagccggcagcctcgtccttaatctcatccctaggcacaatatcgaccaagaagtcgaagatgtcggtcctggtgatggcggccgcgatgtcgttcttctgtagagtcctgcgcttgttctcctcggcgtggagccacgagcggatcgtgagctcgaggatgaacaactcgcaggccttggcgaacagaatcggggcctcggcggagatcatgcgaacgtcctcgtcggccttcatgattttcttgatgcgggcgagcggcagctggtggttcttgaagtcgttcgcttgttcgatttcttgccgctggtaggaccagaacatttggagctgctgctgctgctgttggattaggtgatgaaacggcgccgttgcggtg

SEQ ID NO: 16801 - DNA, 394 bp, Citrus sinensis
  Predicted polypeptide sequence is orthologous to G729
tttttttttttttttttagcaagaacttctatttttatttttttccgcattttcccatcatccaaacaaaggaatacaacagaaccacaaaactgaatgaaatagagatagcaacaatttaaaataagaaaaaaaaacgtgcgaagactcaagtacaaaaattctctcaaaatggaagcttgacaccttgaactggaactagaagctgaccttccacgaatgaggcagtggcgattggttgacatgcagcggcgagccaaggacgatagacgacaatggttgcagtgcgtgtgtttgtgtgaagaagaagaagaagaagataacagcagttggccggctacagaatgtgtttgtttgtgagtagaacaatgaaggggaggaggaggaagaatag

SEQ ID NO: 16802 - DNA, 870 bp, Citrus sinensis
  misc_feature (847)..(847): n is a, c, g, or t
  Predicted polypeptide sequence is orthologous to G744
ggggatctctttttgcacgtgatccctcgctcattcagtaaccaatatacgccggcttctcgcccttgcggtagctccgcttcagctccgcccgccagcatggatgatttagaattcgaagaccccaaccttttccaatctattcccaaattcatcgctggcgccatttctggcaccctcactggtctcttcgctctggctggagctttcacaggggcaattacgggtgctttagccggcagggcttctgactgtggtgttctgcgaggggctggactaggtgcaattgccggggctgtactctctgttgagcttttggaggcttctcgtgcttactggtgtttggaacggactggttctcggggctcctcgtctatggcagactttgttgaggatcttctccgcgggagattcatagaggaacagtttactccagccatattaggtgcttaccactggcaggtaagaattgctagtatgagttacgatgtaaacgataccgactgtagagctctatccagaggattgacaggagaatcactgaaaaaattaccctgtcacgtgatcttggatgaaatcaagccaacacagagtagctgctgctctatatgtttacaggatatcattgttggggaacttgcaaggagcttgcctcattgtcaccacacttttcatttggcatgtgtggacaagtggctaatcagacatggctcatgccctgtatgcagacgggatgtgtaggcgtatgtaggtttgtattatagtttacagaaagaaaatttggggtgaaaccagccagtccacatatacatagtgtgtttgtattgatgagcatacaagtctttcnaagttatttctctatatgtcatg

SEQ ID NO: 16803 - DNA, 869 bp, Citrus sinensis
  Predicted polypeptide sequence is orthologous to G760
ctgatgttgcaaatcaatctgaaaatgctctgcgtcatttgaacttctatcatggagagtcaagcaaccatgttgagcattcaagggacttgagtccagataatcagaagcccatgataggtgtgggtgccacacagcataattcagagctgatggatgcaagaccggtaaaagatgaatatattgattctagcaatggtgtcaatgctggtggcgttaattattttctcaatgagccttacttggatgctactgataatcctcaattcagtgatggattatacctagaagctaacgacctatcaagcactgctgaagctgattctcaagggtttgacatggttgaagagtaccttaatttctttgatgctaatgatgacaactcagagtacctgacttttgatgcttctgaaattctggggagcggagacaacaattctgcccaagcacctctcacaacagagcaggtgactgaagtaactgatcaaatgtccatggctggccagcatcaagctgaagtacatggtaatgatgttgcatccacttcagagcaaaagccagatattgtcaaatccgaatcagatgtcaagtatcccttcctcaaacaggccagtcaaatgttgggcaacgttgctgctgctcctgcatttgcctcggaattccctacaaaggatgcagctcttcgactcaattcattggctcatccgtccagttcagttcatgttactgccggtatgatcagaatcagaaatatcactttaagtggaagtggattggactggtcggttggcaagaatggggatatgaatattgtcttttcttttgacctgtcacaaaatgtcatcagtcctagtcctaccagttttgaa

SEQ ID NO: 16804 - DNA, 621 bp, Citrus sinensis
  Predicted polypeptide sequence is orthologous to G760
tttttttttttttttttaacgagtctcaaagattaccagataacatcacattatcaataataatagtactttcctcctaagaggatttcatagttctttacaatgctgcttaagattacggtactttcctcctaagaggatttcataattgtttgcatgcctccttaaaattacagtactttcctcctaagaggattttataattgtttacaagctacttaagattacagaacgttcttccacccatgcatcgttgtcagcagtgtttgtctcactgccatcatctacataagctgaagcttctccatttgttatgcaacacagaacaaattccttctcataacgggggtcgtccttggcatggtactcatgcacaacccagtcggtcttaactggtaccttagaatcaggaccacggcagtagaaagtcaagaactttttggtaccggtaaggccgtttccagcttcgatttgggaatctttactggtaattttccattgccctgcttctgttcttctgtcgacccggttactgttcctgtacttgtaacgaggttcatagaaaaagtaaaaaacttgatcctcagactcagtttttgattccgttggtaagtcccatgg

SEQ ID NO: 16805 - DNA, 873 bp, Citrus sinensis
  Predicted polypeptide sequence is orthologous to G773, G1412
tttgaaatgtgtggaaatccccacaaacctaatttacttgacgttgcatcctaattgaaatgtgagatctaattgtacaataattcgtgcttctacattattttcttaattttttttttttgggcacctaaccagcaaaaaaagagcaatccaattttgcccattcggtactacaaaaccccacctaactttccatattttggaacctgaagccaaaaagtcagcccaaagaattccaatatttagacaactgccccaatacttccattttttgttaaaaatccctcccgactcaagatcacacttttgtcaacatttcgatgctcgaggagattcgaacgcgagacctctagagtttacaattcgtcaatcacttatcctttcttcataatatcatgcatcatttcaaatgcgcgggcattttacccatatttcaatgtctaaacccaaacccgcttgattgggtcgggtgccttaatccatacgggtcaaccaggctacagaagttcggttgggtcaatacggccgaattatgctgaaagagccccgagttatcaacccgttgattcctaagcccactctgaacctcctcttccaccgagttgcccacccttccggaatttacgtggcacatttggggcatcgaggggacataaaagtcattgttcgcataacaggccaccccatgactctgagtcgtcgtctgtgtctgtgcagcggagacgaattcggggaccgaatgaagacccgcaagactcgcccagtcaaaattacccgaccccagatgctgcaaattgttaaccttgttgtcttcttgctgtaaagtcttgagtgagttcatgcgtggcaaagcgaaaaatcggtcatcaattt

SEQ ID NO: 16806 - DNA, 899 bp, Citrus sinensis
  Predicted polypeptide sequence is orthologous to G778
ttttttttttttttgttccaaaggcacctgtttaataattttttttaattgaagttacaaaaagtattgaaagaaatcagctatatagcatctacacactcgcaggcaatcatataatgattgcacccgcgttgaccgcgcacccgtaagaagggttctaaaagttcaagtcgatgttttggctaagcattttgatattagaatctaacagttgattaagaaatggggtaaaatgcttagctcttagaacttgaagctgggggctgctgctgcatctgctgatacattgcagccattctgttataagcatccatgctcgccgcctgcggttggcaagcaaggaatgtggataacgggtctgtcattggggaagcttgtagccggtcacccaagccatcccatgaggccaaaggcaagaaaggatgaagcaatggtggcatgctggtaatgtttgggcggctcatggagttcatgtccatcacacccatccccatgcccatacccatccccatgcccattgaactcaacatagacatctgaagttgttgttgcattgccattggcaacatcataggtggcatgttcattctactcatcacttgcacttgagcttgtagttgtttcagatattcgatcacttcgtccaacattgaggctttatcagtcttgctggaattggggaccaatttttgcagagtcttcatcctttgattgatcttatcccttctttttctttcagactggttgtgaatagcagcagctctgcttctcttagttgaaattgtggattttccatttcctttcttcttgtactcctcatcacctgcctccctcagaggtctactgtggcaaacagaatcatgatcatcagcagtggttgccttattgccttgtttggc

SEQ ID NO: 16807 - DNA, 822 bp, Citrus sinensis
  misc_feature (20)..(20): n is a, c, g, or t
  Predicted polypeptide sequence is orthologous to G782
tttttttttttttttttcgnaaggcatcttccgtccacacccaatttaatttacaaatattttcaacaatttaccatagcactgtaacggttattgattggtcgacaaacccataaattatggttaaacatcatatctacaatctacacaatctacaatctacatcagtaactatgaaaccaattaaaggatttgtccaatcaaccatttgaaattctaataccatcaaactggtgctgccaaactcgtatattagcgtttaaccctgcatcttcctcgataagaagactatgaaccacccagaacatgatttgaacagccttcatgcagacagatgctcaacagaactcagcctcagaagtcagaattggtcgtgacaacagaagcattctgctgccctcataccaaaattaaatcaatttcaaacaaaagtaacttgaaaacatatagaagtatgcaaatcaattagataggcaaaatcgatggtaaatgcggagaagctcaaaacaaccgggtgcctctttattaactttttatcctaaatcgtcagcctttctgccaccagctacgctatttgatgaactatcttgtacactacgagaagaggaacacctacttgaggaactcccattggtgaaactattctccttcctcaaggactttttggattttctttgtcctgatggaagatcctgatctgttgtcgatccaggagttttcaattctaggtcagttgtgacatcgttagagtcctcattcttctcaatcttgctctcccctgatgacttgtttccagaatcttgtttagctgaaccttgggac

SEQ ID NO: 16808 - DNA, 542 bp, Citrus sinensis
  Predicted polypeptide sequence is orthologous to G791
ttttttttttttttttgaaaacataaaaggcaattgcatacggtatccataataaatggaatatatccacatcattaagtttttcagctcttccaaagcattacattacatagtagacaaaaaacagataaacgaccttacagcataggcatattaattagatgtccaagttaagccaccggaggacgaagtacatgatcctgtgatgtatcaacagcagcaggaggcatgaattgccacattgcaacgccagggtaatcaatgaaaggcaccagcttgttactagcaacctggctttgggcagcaaatgcagccgacattgaagagggatgaggcaaaaaccctgatggagcactcatcgctttgacttgctgttccaacttctctttatcagcctttagcctctgcttctcatcacggagctcattcttctcagcctatattgataaacagcaactaagttgcacatgatcatccaaaccctacataaacatctcttcaattctttaatcttttcttgcaaatcctcagtcgcctcgtgc

SEQ ID NO: 16809 - DNA, 954 bp, Citrus sinensis
  Predicted polypeptide sequence is orthologous to G791
gtttgtttcccaggaaaatttctctccgccggaaaacccataaatattatcctggaaattcaaaatggtttctccggaaaatacgaattggctattagattaccccttgatcgacgatatcactgtccctgatggcaatttctccgtttccgcttcgggtttcacttggaccgttcagccgccaattaacgggccgtcaaatggctgtgtggaaattgattctgcatttggggattcaaatggtctcaaggaaagctcaaaaaagagggttagatcagaatcatgtgggtcttctagctccaaggcgtgcagggaaaagttgcgtagggatcgtcttaatgacaagtttgtggagttagcctctatcttagagcctggaaggccccccaaaacagataaggcagctattctgattgatgccgtccggatggtgactcaattacgcagtgaagcccagaagttgaaggactcaaattcaagtctccaggagaagatcaaagagttgaaggctgagaagaatgagcttcgtgatgagaagcagaggctaaaggcagagaaagagaagatagagcagcaactcaaagctatgagcacacaacccagtttcttaactcctcctcctgcaatccctgctgcatttgctgcccaaggccaagcacctggaaacaagctgatgcctttcatcagctaccctggagtcgcaatgtggcaattcatgcctcctgctgcagtggatacctcacaggatcatgtactccgtcctccggttgcttaagtatgcaacctacaatgatttgggtttgcaatttgcacccaacaagtgtattcgttttatcattgttctctgactgtattagtttttccgaagtctttaatgattggtgggtgactgtatttgaatctctctgtcctatggattgttgctggcttttgcatgtaaaaaaaaaaaaaaaa

SEQ ID NO: 16810 - DNA, 908 bp, Citrus sinensis
  misc_feature (873)..(873): n is a, c, g, or t
  Predicted polypeptide sequence is orthologous to G791
ctttcttttcttgtggtggtggtggaagatcatgtggggtgtgtctccctctcagaaaatcctttttattccactttctcattattcttctatatcttttttgccatcaaacgaaccaacccagttcactcgttccacttttatgatctttttcattcctaaggcacgccgtttgactcgtaacatcatcatcacattgccattgccagtgagactcagccgcattataacggagcaggagatatgtcatcaccctataattccaactggatattcgattgtggtttgttagatgacattggagtctctggtggcgacctcccctcccttgatcctccggaggttctttggtcttcttccacctcaaatcctcctctcagtgcggaattcaatgattcctttggcaatttggatgctttcaaggaaactggctccaggaaaagggtgagatctggatcctgcagtgcatctggttctaaagcttgtagagagaaaatgcgaagagataggctgaatgacaggttcatggaattggcttctattctggatcctgggaggcctcctaaaatggacaagacagttttattggctgatgctgttcagatggtgactcaactgcgtgatgaagctcaaaaacttaaggtgtcaaatgaaaagctgttggggaagatcaatgaattaaagtgtgagaagaatgagcttcgtgacgagaaacagaggctaaaaaatgagaaggaaaatcttgagaggcaagtaaaagccttgagttctcagcctgccttcttacctcatcctcctccagtcccggctccattttctgcaccaggtcaagttgttggtggcaaattggtgcccttagttggctatcctggnagttccatgtggcagttcatgccacctgctgctgt

SEQ ID NO: 16811 - DNA, 925 bp, Citrus sinensis
  Predicted polypeptide sequence is orthologous to G807
gatactcttaccgtcattcagagagtttcttcagaccattcacaatgaaattcttaaaacatttagtgatgacaaaaaggttcctaaacttcaaggtcatgcccttggacaaaagcttttctgctcagcagcactgaacaatggaattcttaagacatttggtaatggcaaaaaggttccataaacttcaagggcatatctttggacaaaagctttatctgctcagcagcacagaacatcaacctctgcaagactcaagacaggctgaaacacatatatacatgaggtaagacctcaaagcctcctgctctcagatgtaagaaggcccatctgctctgtaagatgatccatatgctgaaaattatcccatccatttgcctgctctggctgctgttcaagctcactggtcataccactttccaatgggcttgaattaatctcatctgtgtcacctgggagagggctagccgtaagaaactcttcccaaaatgcatcatcaattcgtggaagcttatggataccatctggcgaaacatccacatcatgatcaggagaaaaggcatcagcgtctatggacattgttccatccaaagctgttggatccaaattttctgcatttccgtttccagacaacacaaaattcacatcagggatgctaatagtgctttctgatgcaattccttgcagttgagggaagttgggcaaaactgtgtcattcccagaattatgcttacttttctcttgtgttggatttactttcacagagtcactcacacaaggggaacattgaatctctgagatggcactagatgggacatgaaaccttgactctgtggacatattagactgcccagaatttggtggaacctctgaaagggtgactcctgaaatttgactggaggagtgcccattttccaatgcatta

SEQ ID NO: 16812 - DNA, 798 bp, Citrus sinensis
  Predicted polypeptide sequence is orthologous to G807
aaatgctctttgtttttaatcattttatgccattctctctgttgtacaaataaaaatttgcaaaaaataaataaaataaataaacccaatcagtcactcactgtaagctgatcgagaaggaaaaaaaatggagtccatgtcgagttcatcagcggcaaacggcaattcgctgccgccgtttctgagcaaaatctacgacatggtggaagacccttccacgaacgacatcgtttcgtggagtagtagtaataacagctttattgtttggaaagttgctgagttttccagggacctgttgcctaagtatttcaagcacagtaacttctcgagctttgtccgccagttgaatacttatggatttaggaaagttgacccagatcggtatgaatttgcaaatgagggatttcttagaggtcagaaacaccttttgaagagtattagcaggcgaaaaccagctcaagtacatggtcagcaacaacctaaacttcagaactcatcagtcggggcatgtgttgaagtagggaagtatggacttgaagaagaggttgaaatacttaagcgcgacaagaatgttctcatgcaagaacttgttaggttgaggcagcagcagcaagctacggatcgtcaattgcatactgttggacagcgtgtacaggtgatggaacaacgacagcaacaaatgatgtcatttcttgccaaggccatgcatagtccaagcttcttaagccagcttgtacagcagcagaatgacagcaacaggcatatttctggcagcaacaaaaaaaggagactgcctag

SEQ ID NO: 16813 - DNA, 811 bp, Citrus sinensis
  Predicted polypeptide sequence is orthologous to G811
tttttttttttttttacataaaaacatatttattcactctctccccttaaggtcggccaaaaaaaataatagtaataataaaacattaaaaaatattaattaccaaaaagcgaaaagaaaaaaaaaattaatacaaagatagaatccaagataaatctcgtgataagcaaactaaaaaccgcctcctagcaatgaaaatggataaggtggcgttggcggacgagactctacccccgttaccatttctccaaaataacccatttgcccattagtactagtaccactactagtactattcctcgccgtcgccggaatcgccgataccggactaggaatggcggcgcagccataactattcatcacttgcctgctttgccctaataaccagccagaacttgaaacactgtaattattgttattattattactatctggtgacggagatgactgacaaaagttgttactgttgttattattactattatcgaacccagaatctggggaagaagatgagatcacccctatgttgcccacttcttcttcttcagattttatcgagctcgaagctgccatgcccgaagaagaagaattagaaggctgctgctgctgctgtgatgacgacgagatcatcaagcgtctctttttgtccccaagataataattattcctgttggtggtgctttctttttccatgatgatgcgaggaagcaagtcgggatcttcaacgactttgtaaagaaacgccatcatttgttcagggcgcctctctgttgcttccagtctcttgttcatgccctgaagctcttcatct

SEQ ID NO: 16814 - DNA, 561 bp, Citrus sinensis
  Predicted polypeptide sequence is orthologous to G839, G1196
agtcgagacaggtcacctctacttccctcattgctcagaagtggttgttgagtttattgattgctatcattgctcagaagtggttgatgagtttttgtattgtgattggtccgatgcttccctcctagaaaagggtactcctgaagagcagatactcagaagggcatacttcatgaaacttaaagaagacatgcaggaggcactgtgcaaggacgtggcttatcaccgtcattcagggctgccatcatcctggtcggcattttacaagtacttggcggctgagagcaatcgttcaggtatgtcgattggtatatttggcacctgggaaactaaaagaatttagtgagctcgattggtatttgtagttctttttcctctggtgatctggcatgtatcaattagttaaattattgtattgtctcatgtccagtgggacacgcaaacgttagtatggatcaaaaactcatttcatataatatttttttgtaaaattatataatttacaggctatgctcaaaaaattagagaaaaagaattgtattacaaaaaaaaaaaaaaaaa

SEQ ID NO: 16815 - DNA, 877 bp, Citrus sinensis
  Predicted polypeptide sequence is orthologous to G843
tttttttttttttttttgctgagaaagagaatcttaattttgattctttgaatacaggttgctgaagtgactaataaactatcgctacctacttcgaatctatgactatgactagattttatctgagtcttcaggaacccaaataaaaaataaaaaatttactgtacaactttggtgtacatgcattttgaaaaatgaaagggagatggaattaggatgtgtgtgatcatgcttgagcaattccctttctcacaagcatatcatataccctatcaactttatttggttcaaccttgaacaggttatgagcatccgattttttgctaacgttgcccttgtatatctctaccgataagatctccaacattttgagatagtgtgccggtagtatcttaatctcaccacagagtcgtttctcagtttcagaaagtagatcggcacccacaaacccagagatgtcccagtcttccagggagctagcaatagttgagtatgaatcattgccaaatggctgcaaactggtggaacccctcacaactccacgagggctgacctcaacttcacccttgagactatttggcctctgcaacactttaccacttggaccagcctggccactttccttcactctctggccattttcctcagcttccttcttcctcttctgttcgagaaatctatgtgcctcagaggatgtacgacaaccagcagcttgtgcttcctgaagttcttgtattcttttgacaatccgatgttcttcaataacactcttcagcaactcctcatgatcttcttttgagtggaaccgcatgaagaccttgtatcgctgatatatgtccctctcttcgggtgagagattcctctcaaatggatcagg

SEQ ID NO: 16816 - DNA, 355 bp, Citrus sinensis
  Predicted polypeptide sequence is orthologous to G849
tttttttttttttttttatggggaatcccacaaaaaaaacagtccccttgattacaaaaattattttcccaaaagcttaggaaataacaacccccgtaacttaatctatcccgagctaaacatactacccttcaaattcaaggccggaatctttcaggtttctcaagtacaaagcttacgaggatctagcagtatcccaaattacataccaggaaactcttaagtattggaatcaaaacccaaaaaaacagggattacataaaccccatatctgggaaaaaaagggattccttcaattaaccttcaattaactaggggaaaaacaaaaccaatctttttgaatctgaaaactagg

SEQ ID NO: 16817 - DNA, 887 bp, Citrus sinensis
  misc_feature (32)..(34): n is a, c, g, or t
  misc_feature (47)..(49): n is a, c, g, or t
  misc_feature (885)..(887): n is a, c, g, or t
  Predicted polypeptide sequence is orthologous to G852
gcggggattctatgtgttggggagacaacatnnncagctcaacacgnnnactacgttgagttactctgaaagaaagaagagaagattaatatcctcaaagcttcatgttcaaatttcaatcttgactctaattaaaagatatggcagttctataacttatttgcatatcctactgttgatcaagatatgctgattggtagcttgttacttgttcgcgaataagcaatcttgcctagtaaaagaagcatttccattacaagttgctgatatactcctgccggtcattctttgtgttccaagtggtgcgtgaattttagatgcaaacatctcagaaacaccaaagtgcagccagtgtccaacgaatgtatcaccagcctgtgcaagggattgaaccctgttgtttgtctcatgtccaaattttggacaacaatatatgctcagatgttagcagtcaaggaaccaatatgtcctttcaaacctacaaggagcagttctataccctggattcatccacagcaactactggtttttctcatgactccccttctgctgtcagcatttcatctaatcggagtaccttttctccacaaggttctcagtcgtaccagtcagatcctcatcattctcctgacaatgcatatggatcgcccatgagtggatcgtccattgttgatgagggcaacgaactgaggaacaaactgagagaactggaaatatccttattggggcctgaatcagacatcattgacagctgcagctgttgctttaagagtggcacccaccaagacacttctgcagcaagttggaactgggatcagctgatggaaatgatccccagattggacttgaaacaggtgctgattttctgtgctcaagccgtatctnnn

SEQ ID NO: 16818 - DNA, 693 bp, Citrus sinensis
  Predicted polypeptide sequence is orthologous to G852, G2633
tttttttttttttttttgttcttccaacttgcatttaactttctatctttgcgccaaactacttgattagcacaactttccaaggataaagcacgcaatcacagtcaagaatttggctcctgttgtgaacgtgacagaaacaaagatgtcaaaacattgaaatgttcttgaagaaacagcctaactttgataatataagtacacaattgatggcaatttcataagaaagccattagcagcaaaaacggaagcatagaagaatctgagctgcgcctcagccgctcccaggtccccaaatgattccggttatcatctccaagcacaggatgcaaccaaatctctattcatccagccaagaaacaaagccccatctctctcttgaagtctatatctattacagtagttctctagcagtgttttgattgtggcattaactacggaactcaaaggatatggcctaaaccctgccattgtgaatcgggacctccatttgccaagaagctcatgacgttctatcctctcaggtccttcacaagctattatgttaacaacatccctcgctaggcaatgctgctcaatgttgatccgctccttatgatccctagcaaggttcacatcaattgattcaaacattgccgtataataattcagtgccccgaggaatcgtgggtagaaagcagcaatatttgtgtt

SEQ ID NO: 16819 - DNA, 733 bp, Citrus sinensis
  Predicted polypeptide sequence is orthologous to G861, G1140
ttttttttttcctttttttaatctcttttccttctcccatattctctcgtctctctctatcgctcattggtggcattttcaaagtctccattccgaagttttaaactctcccacaaaaccaaaccacattaccagccgatctccataagccaaattgggaagatcacagcagtaacagctagcaagcaagggcaaagagatggcgagagaaaagattcagatcaagaaaattgacaacgcaacggcgaggcaagtcactttctctaagagacgaagagggattttcaagaaagctgaagagctttctgttctttgcgatgccgatgttgctctgatcatcttctccgccacaggcaagctcttcgaatattccagctcaagcatgaaggaaatcttagaaaagcaccgtgtgcactcaaagaaccttgagagggtggatcaaccatctgttgagttgcagctgttggagaacaacaactactccatgttgttcaaggaagctgctgaaaaaagccatctgctgaggcaaatgagaggtgaggagatccatggattaagtttagaagaattgcagaagcttgaaaggtctcttgaagttggattgggacgagtgatagaaaagaaggaagaaaagattacaaaggagattaatgaactccaaagaaggggaaagttattgatggaggagaatgagcgattaagacagcaagtggcggaggtatcaaatgcatac

SEQ ID NO: 16820 - DNA, 880 bp, Citrus sinensis
  Predicted polypeptide sequence is orthologous to G861, G1140
tttggtttacaaattaatatccttttagtttggtgatcattcttccagcccacaagcttaaatatgtcggcaattatccagaagtgcttacacaattggaaaagacaaataaaagtaaaaaccaaaaaatagctatcttgtagatgtccacaattaatgcaaacatatacagtacagtacaatcacaaatagcagtgacaccaagccaacgataatcggatcggcgagaatccagaacaagtctcttcttggatatgttccgctttgacaattccataaacacaacagcatctaaaaaatatggcagggttacgactttattcactgtggaattaatcctctttatttgattgtctgcccccagttcagctggagtagggaagccctaatttgagagaagtatcagaactatcatcctcaggaggagggccactgctgcagctgcagacgttgtttacagattctgatgacatgccttcttcttggatagcaatatctgaatccactaaaacaactctttttcccttgcacgaggaggccaccttctgctttagattcttgttctcctccagcagcttagctcccttcctttcaagtgtagagatctcattcataatccggtcaccctttgtctggagcacacggctaagtccctgttcaagcattgtttcaaggtgctggagttcctcaatagtcaatccatgaagatcctctcctctcatctgccttagttgacggctcttatcagcaatttccctgctcaaactgagatacttgctattctccaactgcagttcaagagatggatgattcaatttgctgatgttacttgaatgcatgttgtaccttgcaattatgtccttcatgctggagctggagg

SEQ ID NO: 16821 - DNA, 879 bp, Citrus sinensis
  misc_feature (31)..(33): n is a, c, g, or t
  Predicted polypeptide sequence is orthologous to G865
gcggggactctcccattcaatcctcaacttnnntgtctacaggtctgttaacaaaaccaaacaaaacaattactttttccgttgtatgtaataaaatccaataaaaaaattattgcattacattagagtttatagaagtgcttattgtaactgcaaaaaagtggatcatcgaaggcatggaaagcggccacttccactggaagcatcaccggaggagaaagagaaagaacaagacaacaacttccctgcttggactactcatgaatcagacatgtctgccatggtttccgctcttacacaagtaattggcaccactaccaccgacgccgacgccgacccctcgccggcagccgttaaagaagaatcctccgataacccacttcaacaaactcaaactcaagatcaagatcaagaaggtacaaggaggagacattacagaggagtaagacaaagaccttggggcaaatgggcagccgaaattagagaccctaaaaaggcagcacgagtatggctaggtacatttgagactgctgaagatgcagccatggcttatgataaagctgccctcaaattcaaaggcaccaaagctaagcttaatttccctgaaagagttcagggtactactgagtttgtgtatttagattcatcatcatcaagctctgcctttcatcatcatcatgagtcggtgatgcctgctcctcctcctaggcctacatcaatgcaccatggtgcatacccggacttgcttcaatatgctcaaattctatcttctgatgatgctacttttaattactatacgtccaatctctttaatccacaatcatcatcttgttcttcttctactccttcgacgttgtcatcatctaccacctcattgga

SEQ ID NO: 16822 - DNA, 763 bp, Citrus sinensis
  Predicted polypeptide sequence is orthologous to G872
tttttttttttttttttaactttaaaaatgatttattcatttatttgaaataaaatctaatacaattcaattttcttccgatcaataaaaaaatttacaacttcgtaattttttttttccaatcgaatgatatgtttactcgtactcgattactaatgaaggatgaccgtacaaaaaatggtctatccaaacccaaattatcagatactccggaatctaaaactgtccagagttctgacctcacattactaatttaaaaattccaaagaaatgaatcttgatttaacaatagcccatcaaaattctcgtctgcaaaatcaacagctgggagttgcggagtaaaaatgtcattagacaggtcatcaaacccaggaaatatcccatattcggaagggtagttattggaactcgatgccgttaaaagatccaataaagacccgtcaaaaaccccatcgctgtccaactgaaccgttgcctcagaaatcgacggcgataagtactccgtttgcaattcggacaccgactgttctggtgattgactcctcagcggctccgaattcgcgaactgagccgccacagcttgaatctcagatggcttaagtgagcgcccgcctgatatgtcgggtgggttgtccgggaaattaaacttggctgatcggccacgtaagcaaaacaaagcagcgtcgaaagcacgcgctgctttttctgctgtgtcgtaggagcccagccagatacgggcacggctgttgggtagtctgatttc

SEQ ID NO: 16823 - DNA, 744 bp, Citrus sinensis
  Predicted polypeptide sequence is orthologous to G878, G884
tttttttttttttttttgcaatcaacatacaaaggcgtttttatttatcaggcaaaaacaacatacacatttccaatctttcatggaaaactaccgtctaacgagaaaaatcagacatgatattaattgcgaatccaaatgtacaaaagcaggttgtcttggaagggcaacttggcagctagaaacgcatatgggaatccaatatcaaccaaaggccatgatcttccatatgattctttttcaccttgctccctgtaaatttgccgtcaccagcttcttaacaggcttagtgattacttaactgatcttggcagaagattttacactatgatttgctcttcctttagccggagaagcactggtctttggtcatcatgtccgaaatccatgtctttaagtaaggggggcttctcggtcaccactttgtttggttttagccgtggtggtgcactatggctgccattttttgctgctgggacatcatgattatgtttcccctcatatgtagttacgacagctttggggtctgttggagctctctcaacatgcttacgaacattgcatccgggattagtgcatttgtagtagctccttggatgggggttccctttgaccactttctgcccatacttacgccacctgtagccatcatctaaaagatcaacttcacttcttgtctgcacaatgatctttggctctgtgactgtcttttgagacaacactatctctgattctacagcgatg

SEQ ID NO: 16824 - DNA, 479 bp, Citrus sinensis
  Predicted polypeptide sequence is orthologous to G892
tttttttttttttttatatcaaatataaatatattttatttcatacgtatggttttaagataacgaacagagccttaattatttctagcctgagattatgcgatgacgccactccgacatacagggcaagaattagaaagggagatccacgtggagatacacgttgcatggaacacgtggccgcatggaacttgcttaccgggaaatgcctgcagaaaattttccatgcagaccgtgcaacggccttcggtggcagcaactgttggcaagctcgacaccgtcaattcactgttcgtttgcccgtcgtgactctttggttggtcttgatctggtggcgttgacgacgtgtttgtgatcatcgttagtgcctcgtcgaggttgaagctttcatcaattattggactgcctgaaacgatattagtgttgatcgccagataatatggagacgccatttttgagtgagagatagagcctcgtgc

SEQ ID NO: 16825 - DNA, 795 bp, Citrus sinensis
  Predicted polypeptide sequence is orthologous to G896
tttttttttttttttttccgcagatcagtccaataatggagatatatatcctttaatcagcatctcttattctgaaaacagaggaagggagaaaagagaaccaaaagtacaaatattggacaaatatatgattgaatcaaagttttcacaataactgtacacattgacagaacatacttcaaacaaattacgagctcctggataagaatattgcttttactagtagttatagggagaaaggctttgtatagacatcgaacggttcattggcagtcaactgaggttcctgtctgaacccgccactaagactccctcctgtcaaaagcatggtgaccagagatgttacaagaccaccggcacctgaaagctcactaccactgtctgtgttacggatggtagatctcattgagttcagcatgctcccatatgtagctccatgtccacgctcaatagcttggatgaaagaataagtcatcgcaccggttgatgtgatctttgacagagccgaagtgtcagcagatgtttgattatcatcacagccgctaaatgaaatagcctccccaccacttgtccctttccacattcctgatcgagggcggtgatcctcccatatatatttcccctgcctgtccatcctacagagaaatggtaagtctaacacggttccactatgacaagcatctataattgcatgaagcctggccccacgaggaagaggccggactagagttgcgttgatctcatcatcgacaatcattccttgggtttcgaaatccactggacaaagagtttcat

SEQ ID NO: 16826 - DNA, 305 bp, Citrus sinensis
  Predicted polypeptide sequence is orthologous to G896
ctgcgtggcctcctcctccggtttatgggaggaaaaaagcattgctatgtggagtaacatataatgatacaaattacatgcttactggtagcataaatgatgttaagagtatgtggtttcttttggttcgcatgttagggtttcctagtgactgcgtagtcatcttgacaggtataaattgctctctactaagttaataagctagcattattgcatttttttggctaataccttccgttaaagctcgatcttatttttcagttaccaatatatggcattcaattacttttaaaaaaaaaaaaaaa

SEQ ID NO: 16827 - DNA, 812 bp, Citrus sinensis
  Predicted polypeptide sequence is orthologous to G912, G2107, G2513
caaaagcccatcaaaagtcacttctaaaatttcaacttaaacttcatatcaatggattgcatatcgagtcaaggcgagctgctcactcacactcagacaacgaagttcaactacagattagcaacgagcagccctaagaagcgagcggggcggagagtgtttagagagacacgtcatccgattttcagaggagtcagaatgagaaacaataacaaatgggtatgcgagctgcgtgaacccaacaagaaatcacgcatttggctaggtacttatcctacgccagaaatggctgcgagggcacatgatgtggcagcattagccctgagagggaaatccacgtgcctgaatttcgctgactcggcatggaggttgccggtgccggcttcggcggatgctgatgatgtaagaaaggctgcagctgaggcagcagaagcattcaggctgtcccatgatgatgaagatcaatttgaagaaaatggtttgttgccggagaaaaatgtgttttacatggatgaagaggcggtttttgatatgccgggactgcttgtgaacatggcggagggtttgcttctttcaccaccgccactacttattggatgtgagtatgatgatgatgatgatacgaagtggaatgattatatatggggacattgaagtaatagctagctctgtgtcgttgcctcattgcctgtggatcggagtccttcgatttgatgtgcgtctagttaattaatgctgtagagttgtgtttctttttgttctgtctgtttagtttcagcaattaggaaatcttcaaacaattaggatacaaa

SEQ ID NO: 16828 - DNA, 801 bp, Citrus sinensis
  Predicted polypeptide sequence is orthologous to G921
ttttttaaaagggaaaaattctcctttttcgttaattttgaagttccatgtaatgtacattaatattgcaaggtatggtctccagactctaatcctccattaaagtaactaaagcaaagcaaaaatacagaagttgatacaaattaacatccataatctgtgttgatcctggctagctagagtgaccatctttgtgttcgggcctgatcagcaaatcttcctgaaatagctgctgcaagtgctgctgtaaaattaggatctttggtcaaattagaagccatttgttggaccaaaatctgatggattgctggagcttcaatttgttgaactgatgattttttggcatcatcaaacaaaaatccaggttgaatcatatcaagagttgcagtagggcttgctgatagcatcgatgacgccgcagaaacatgaataggatttccaatagttgcaacatggctagggctcaatgataattcagcttttgaatccgtaggctgaggatgattatgctctccttcataagttgccactaaaattgatggatcctcagcacttctttgcaccttcttctttacgggacagcttggggcgaaagaacacttgaagtaagccctaggtgatgggttgtctcttgtaaccttttggccatactttctccattgatacccatccttcacaatcagggttgaatttgaatcactggctctcacataaaacctagaaacttttgccttggtgttgttatcctttggccttttgcatgactcttcgtcagtactagtgctggactcagtagcgtgt

SEQ ID NO: 16829 - DNA, 825 bp, Citrus sinensis
  Predicted polypeptide sequence is orthologous to G922
tacagaacccactaaggaattttcacctctcaatttgtttggttagttctggtttttctttcttttattttttttgggttttgcactgtttcatactgttgttttcttgtgattttgatcttaacttgcttaaattttcgttgattcttgtgaatgctacatgcacacttaggcgagttctgattcttggctattatttttgcttatttaatggtaccaatgtttcaagatgatggatcttcgtctgtaacatcatcatcatctcctcttcaattcttctcaacgatgtctcctagtttaggctcaccttatcaatggcttagagagcttaaatctgaggaaaggggcttgtatttgattcatctattgcttagttgtgcaaatcatgtagcaaatggtaatcttgaaaatgctaatcttgctctagaccaaatctcgcaactcgcctctcctgatggtgacaccatgcaacgcattgctgcctactttaccgaggcacttgctcaaagaatcctcaaatcttggcctggccttcacaaggccctcaattccactagaattagttcagtttctgaagaaatgcttgttcggaaactgttttttgatatgttcccgttcttgaaagtggcttttgtgctcacaaatcaagctattattgaagcaatggaaggggaaaaggtggttcatgtgattgatctaaatgcagctgagcctgcacagtgaattgcactcattcaagctttgagtacaaggcctgaggggccacctcatttgagaatcacggggattcatccacagaaggaggtgttggatcaaatggctcat

SEQ ID NO: 16830 - DNA, 844 bp, Citrus sinensis
  Predicted polypeptide sequence is orthologous to G926, G2632
ggggacagtatctgtgtctctcttaaggttgcagagaaatacagactaaactaaaacgaatcaaagtcggtgactttcttttagaatctctatgctctgcttctcatctcacagtgcaggattaggctgtttatactattagaggattaggttgtgaatgatgccggcaaaacctgatgaaaatcggcagttagaccgtggtgctcagagtgtctcgcaatcagccatctattcccagcagccttggtggagtgggacaggaactggtgcctccttagctgaagcagcagcttctaaatcttcaagggaacaaccaaatggttctgttgtaaatggtgccacctattcacaagatgggattaatggacaagaacatgcgcatctcaaacatattccatcctcaacacctctagctatgggcgaacgccttgaacaaaattcccaaatggagctagttggtcactcaattgttttgacatcatatccatatacagatccacaacatgttggagtaattaccccctacgtgccacaagttatgattcctcctcagttatatggaatgcatcaagcaagaatgcctttgcctctcgaaatggaagaggagcctgtttatgtgaatgcaaaacagtatagaggtattttgagacgaagacagtcgcgtgctaaggctgagcttgaaaagaaagtgattaaagcgagaaagccttatcttcatgagtccagacatcaacatgcaatgagaagggctaggggttgtggaggccgttttctcaatactaagcagctcaatgacaatgctgcaaactctgcagaaaaaggtatgaattctggtgcagacggt

SEQ ID NO: 16831 - DNA, 817 bp, Citrus sinensis
  Predicted polypeptide sequence is orthologous to G926, G2632
tagacatttcatttttgttttgttcactagaaaatggttaaagatccagactgccgttaccgttccaagttaatccatgcgactatttctaatggagtttatcaaacattatctgtacataaaaaaagaggggaggaatgacgataagcagctaaaaatgacttgcaagaagccacgaggggcttattcatctcctccctcattcacccacaatccatgcaaaagaacgaagccaagaatgatttgccggccacaagacaaccaagaaactacccttcagtatatcagtgggtcttcatcctccatattggcacgagacggcacccaccttacctgcaaaagggctcactgaatagcaagaggcctctgcgatgcctggttggaagatatgcttccccactgcttgcctgaacagtctccagtttcccctctatcacctaagtgtgaatggtatgttgatgcttgaaggccatgattctggtaaccaccattggcatttgcatgattgcgagcttcatgcatgttgtgtgcttgagacccacctacatcttgctgactagctgaagaattccaggtttcagctgagtcggatggcacgggttcagatccagatgaactgccagacagagatggcctgattcccgaacctccacccttcttttcactattacccttggaagcatcatcagttttctttgcaaaccgtcctccactaccccttgcccttctcattgcatgctggtgccgagactcgtgaaagatacggctttctaacttttattagtttcttttcaagctctgctttagcacgtgcctg

SEQ ID NO: 16832 - DNA, 657 bp, Citrus sinensis
  Predicted polypeptide sequence is orthologous to G927, G1334
ctattattattcaagatatcaaagagtcataaacccagaaagcataaatagcttaagcacgccacactaaaacgtttttcagaatcataaacacattatctggactcccacacttttattttcagacttaccaaaaccaacccttctatgttccaatcctttatttaactacttatacagtgcatcaaggtattggcatctctaaccattccaagctgcctgcttggaatggcaaagacgatcaccttcacgcagatgagccaagaatgatttgcctaaaccaaacggtaggtggacaatccacagagctactccatttggtcgaaggtaaggatgggtttggtgcagcaccaatcccaaatggtttacatgctatcaaactttaaggttgcagcagttatcagctgctgcaacccactggctgggcatgacaatgccacgcccggtgtccataatgcccgaaaaagagtggacaggtggcccgagatgattgatccgaaagtgaccaaactctccccttgagtacatgctagtcacctccgaccctgaaagattagggccactgccatttgtttcttttggagaactcaaagttccactctcagactgcaggacttcggaactctgagagccagtgggctgaagcaattgctgaat

SEQ ID NO: 16833 - DNA, 767 bp, Citrus sinensis
  Predicted polypeptide sequence is orthologous to G929, G2344
acctagcaggagcagcagaaggagagccagaaacagcctgctatagaacacagtgcctagtttctctataagatttgagttgcagattctatatgcgtgacggcctcatgacttcctctgtgcatgatatgtccgataacagtgacgctgatgagcagcggaagcatccagaatcccagttacagtcctcaacacctgcaatgggaatgtctcatccaagcatcacaactcccaatgttcaatatgcaacgcatcaagtcggggcaggccatgctatggcaccagcagcttacccctatccagatccgtactacagaagcatatttgctccctatgatgcacaaccatatcctccacagccatatggtggacaaccaatggtccatcttcagttgatgggaattcagcaagctggagttcctttgccaacagatgcagttgaggagcccgtgtttgtcaatgccaaacaatatcatggcatcttgcgacgacgacaatctcgtgcaaaagctgaatctgaaaacaaagttttaaagtctcgaaagccatacttgcatgaatctcgacatctgcatgcattaagaagagctaggggatgtgggggacggtttctcaactcaaagaaaaatgagaaccaacagaaggggatggcatcagatgacaaatcacagtccaatctcaatctcaactcagataaaaacgaaattgcgtcctcagataggcagtcctaattttttatgtatgaataaataaggtcagaggtctct

SEQ ID NO: 16834 - DNA, 836 bp, Citrus sinensis
  misc_feature (812)..(812): n is a, c, g, or t
  Predicted polypeptide sequence is orthologous to G938
gggaatcaggaagaagctttgtctaggaaactgtatcctgatagctgccttccagcgtctactggaggaagtggttctttcatcattagtgatatcagtgattatgatgttgaaggagtagacaatgaaaggaatgttgaagtagaggagattaaaccactcgaagccaatcttttcaacatgggtgctatgggatcaagagatcggtttatgatgcctccatccttggttcctcgaatcaagggagaggttttcgagacccactcagaatccattcagaagaggaggccgtcggctgatgagccacatatgacgatggatcaaaagatttatacctgtgagtttccccagtgtccctacaatgactaccaccatggctttctggacaggacttcgagaaacaatcaccagctgaattgcccataccgcaataacggttctcaagggtgtgtaatgccaaactttcaaattaacaatgaccaacctgcagtgttctctctaccatttgctcagtctactcacccgaagccaataacttcagtgaagaaccagactcaacctcagtataatgtatcgggacttggacttcctgatgatggacaaaagatgatttctgatttgatgtccttctatgatactaatcttcagcctaataagagcatgagtcaggggtgtctgaacattacggaagatcgaaatcagcagccagagcagcagaaatttcaacttcagctggatgatagcttctataaccaaggcataggtgttatgaaggggggcaacatgcccatgaacaaccctgttttctcctncactgaagttcattttgatcaatg

SEQ ID NO: 16835 - DNA, 805 bp, Citrus sinensis
  Predicted polypeptide sequence is orthologous to G938
gatcaatcttctcttctttctgtgcttactttcttctcgggaaagttgaacttaactttaccaattttcccgggaaatttgtgaggattccacctgttatatatggtaaaaagggttgcgatactcgggcaactttgaagttttaatacagttgttgctcatagatagtcaagggaaggaggtggttttattgcttgaagtttttttggttatagtcctattagattagcgagagacttgcaaatttggagtttctgtgggtgttaacgctgtgggaatgatgatgagttttgatgagatggggttttgtggtgacatgaacttcttctctgctcctctgggagatgcagatatggccgtccaaccatctgaaccggaggctaccgtggaggatgattatactgatgaagagatggatgttgatgagcttgagaggaggatgtggaaggacaaaatgcgtatcaaacggctgaaagaacaaagcaggggcaaggagggaattgacatggccaagcagcgtcagtcgcaagagcaggcaaggaggaagaagatgtcgagggctcaagatgggatcttgaaatacatgttaaaaatgatggaagtttgtaaagctcaaggttttgtctatgggattattccagagaaaggaaagcctgtgactggggcatctgacaatctccgtgagtggtggaaggataaggttaggtttgatcgtaatggtccggctgctataactaagtaccaagctgataattcagtccctggcaagaatgagggcattaacgcaattggtccaccccgcata

SEQ ID NO: 16836 - DNA, 901 bp, Citrus sinensis
  Predicted polypeptide sequence is orthologous to G938
tggaaaacaagcatacattaaaaatatgtgtacataatgtatatgtatatatatgtatacaactactggccaataccaaccatagcaacaagaaactgttcctaaacttcaatagcagcagtgaatattgggttgtggttcctaccagttacttattgcccatcttcaatactgcaatgaaagcaaaacctaaaaaccctagacttgaaacataccaaatttagaaggaagaagtctcgcacctttggagcagaactcataacagcaaccttcttccaatgatgtacagcgtttttttctagtctgctagagaccacataaaatgtaagcactttatatgacaggtccatttccttcttcaaaggtaccacagggatacatcttgcttcggaatagaatccatggcgtaatcaactgatgccatgttgaatggagagttaaatctaaagtcagtgataccgtcgctgggattggcatcatatggggaatcaaatgctttgcactgatcaaaacgaatttcagccgaggagaaaacagagttgttcattggcatgttagattgccctggcatgttgcgtcccatcacagctccttggttataaaagctatcatccatttgaagttgaaatttccgctgctcctgctgctgattctgatctccaatagcattaagattccctgaattcaagctcttgttctgctgatgattagtatcatagaaggacatcagatcggtgatcatcttttgtccatcatcaggaagttcaagtcctgaaatattgaattgcgattgagtctggttcttcggtggagttgccggcttaggttgagttggttgaccaaaaggtcgagagaaagccacagtttggtcattgttaacttgaaagtttggcatcccgaa

SEQ ID NO: 16837 - DNA, 879 bp, Citrus sinensis
  Predicted polypeptide sequence is orthologous to G938
tttatgggaattttaccacctttcttattagcccatctcacaacctgcttcgcttctaatttctacagctaaaagaaaaatacaactaacagctttttaacataattaaagttttaccacatcataagccaataccgaagccataaaatatgcccagaggatgaggatgagaagctggcattgtttttagaaccagactgagctatcatgcttcggcatggtatccacccctgctgcttgaaaatcctctttataatcgaaggatcctaagtcgaatggagactcaaacatcaagctaaaattgttgttgctgccgctgctgttgttctcgaatggagaattcataatcttaaaccgatcaaattgattttcctctcgtgggaacatcagatgattgttatcatgcatgttggatccttcgaacaagttcccatccattacagctccttgaccatggtaatactcctgctgatgctgagctcttggctgaagagtattttgaccttctgtcacaacggcgttgttactgggattcacattcctgtttccttggatattgttatcatagatcgacatgagctcactaatcattttttgaccatcttctggaactccaagtcctgatatatcaaaggaaggttgcacagaattaaacgttggacctgctggcttggactgggcaaatgtttgagggaaaataactggtttcacttcattaacatgaaaatcagacccagcaaactctgaagcaccacttttatatgggcatgtcagctggtgattgtcccttgaagtcctgtcacaatagcccagacgaggatcactgtaaggacactgaaggtattcacatgtgtaaatatgttgatccatcttcatgct

SEQ ID NO: 16838 - DNA, 902 bp, Citrus sinensis
  Predicted polypeptide sequence is orthologous to G938
accttccctctaaaagcaggaccagatcaaattcatcaaacctttttctctctcctctgttttctctctctaaaagtgggtttcaattttaaaaaaagaaaaagaaaaagaaaaagaaggcttcttggattactctatcgaacaaacaaataattatccggagttcacacttgatctacttttgcttcaatttttttttttaaaattttgaattgcaagtgtgtggatttgagaatctgaaagaggaaggaagagaattgaagtgggtttgatttaagttttgaatcggagttgttttctgttggcttatagtgaatgggaatctttgaggaaatgggattttgtgggaaccttgagttcttctcgtctccccatggggaaggagaggcgtttctggaacatgaacatgagacggcggctgaagaggattatagtgatgaagaactggatgttgatgagcttgaaaggaggatgtggagagatcggatgctcctgaagaagcttaaagaacagagcaagagtaaggaatgtgttgacagtgctaagcagcgtcaatcccaggagcaggcgcggaggaagaagatgtctcgggcacaagatggaatcctgaaatatatgctgaaaatgatggaagtttgtaaggctcagggttttgtgtatggaataattcctgagaagggaaagcctgtgagtggagcatctgacaatcttcgagcttggtggaaggaaaaagtcagattcgatcgaaatggccctgccgctattgccaagtatcaggctgatcatgcaatccctggaaagaatgaagattgtggttctgtggtgtctacacctcactccttgcaagagcttcaggacactactcttggatctcttttgtcggctcttatgcagcactgtga

SEQ ID NO: 16839 - DNA, 475 bp, Citrus sinensis
  Predicted polypeptide sequence is orthologous to G961
ttttttttttgaaaagaaaaaaagggggaagaaaatgttagctattaattaagttattagaagctatttcatttgcaaaatggatgttttctatatgaattgactgatttgtttctttgcttgagttggtcatttgttgggaatttatattactcaaattgacaattgaaagaaaaaagtctcaaatttttagacggggattcgcaaatagttaattctcttattaggtgcatcaaagaagcccatttttaaagttaatttcttctggaaaacattcattgtattgtgaggcacgggcaactgctgtggaaacaaagtaaaaggtacccagtaggtgcttctaaatagtgtatgttgtatgatcctcatgaatggagcattttttaaaaccaattctaaatattgtttaaaactttcaggattactggttctttattgatgcgagagagaatattgtcttggagaaattcattta

SEQ ID NO: 16840 - DNA, 871 bp, Citrus sinensis
  Predicted polypeptide sequence is orthologous to G979, G2106, G2131
ttttttttttttttaccacgaatcaacataaagttggattttctttgaaaagaaaaaaactttaaaaaaaaaaaagattaaaaaagaaaaacccatatttcatccacccaccaacaacaaactcaaaacaaacacccaacaattttgtttgctctccaaccctcttaatgatcaccactacttcaaacactataattacaagaaaccgaggttgttgttgaagaaaatggcgatgatgcatttgaagaagtcgaaaaagccgacagcagcctcgagacaactaacttattaccattttcctcttcctcctcctccatgttccccgtgtaattgtcgttgccctcgggattattttcattaatgtacttcgacacttcttctgcttccacatcgaaaatgaagtctatgttgtcctcgaacaaccccgtgttatcgaacaagtccggcagctcaccggcgtttcccattgggatatcgggaaacgttagcggagttaaccctaccgccgtgtccaggcagaaactccatgttagctcgtgctcgtcagtagccgccatagcacaactcgcgtccatcatgcatgaaggaagttgtgtgttttgctgaagtacttgctgatgaggtgaaactatttcttcttgttgcggtaataatgctggctgcgtttgctgctgctgttgttgttctggttgtggttgttcaacttcgacttctgcttcggtttcttcggattccatcgaggaattcggaagagggaaaattcctttcttcttcaattgatcaatgtaatgactaaagtcaaagttggtcactgcatttgcacctctatactcaattgccgccatgtcaaatgctgccgctgcttcctctt

SEQ ID NO: 16841 - DNA, 880 bp, Citrus sinensis
  Predicted polypeptide sequence is orthologous to G987
tttttttttttttttttactaaaggaaatatttacagaaacaaaaccatgaggtctacactggagtaccatcacaaacagcccctgcaacagaacttaggggattggagaatgtccccaagcttttctctaccgcatgaagtttctaaacctataattgtctaccaccaacatcatcaagataaccatactttgcacagggaccaacgagctataaccatactacagtaattgcaggatcatctgctggtttttttttttattcactgatgataaacaccaggtcaggaatctgaaatcacaacaaaaccacaaacagttagctgtgttctaaatttctgcattagtcaattttctagaaccaagcttgtattgctgcatatactttagctttgttctagatttctccattaatcgattgtctaaaaccaagcttatattgctatatatactatgattattctaattttcatacatacacgcataatgaaatacgtacatggacatctcatatatttgaatgtacgtgaaagagaaagcaggagagaataaaaataaacttgttgggggtaataccttcatccacttcccaggttattctttcctgactggtccaggaaaaatatcatacctcccaatcacaactctggcgcaggtacccaacaagaggaagcaaaaacaattctccccttccatccctgcagcatccagttgttgtcttgatcaattacaaagtccttgtggtaccaagccttcaacttacccataagtttctccatcagctcctggttcagtggcagctgcttaaacccagcccttatggtccgcgcctgccattgcttgtatgtctcaggcctctcaaccctctccaagccctcaca

SEQ ID NO: 16842 - DNA, 927 bp, Citrus sinensis
  misc_feature (918)..(921): n is a, c, g, or t
  Predicted polypeptide sequence is orthologous to G1017, G2567
ggggagccaggcatgctcaatttggaatatcttcatcagatttccatgttaacaacaaactgcagtcagggctgtttctatccagtttgcagcggttcactccaaattctagagattctgatggcatcctgacaagccacacaaacagtagtgagaatttatcttgcttactgacaatggggaattctaatcagaatttggagaaatctgagaacataaaaaaagcaccagtttttactctttggtcaaccaatactcacagagcagcagatctcacacagctgttccgatgatgtagtttcacaagtgcttgggaaaagttcatcagatgggcattcagataaagttaaagcatcttctgatggttcaggatctattcatgagcagagaatttcaatagaaaagtcctccagttctgaatttttctggaatcgaagtttccaagtgactgaatctggtcttgatactggtcattgcaaggttttcttggagtcagaggatgttgggcggactctggacctctcagtgctgagttcttatgaagagctgtatcgaaggctggccatcatgtttggaatagaaagatcagacatgttaagccatgtgctttatcaagatgcctctggtgctattaaacgaacaggagatgaaccattcagtgattttatgaaatcagcaaaaagactgactattttgatgggttctggcagtgacagtgttggaaggacatggatcacagggatgcggactcctaagaatggactcgatgcttccaataagactggtcctttaagcatatttgcatagttatctcagcagttgagagtagatgttgaaaaacatgaaataatgttaagaagttgttagctatccacttcttctgtgaattgaaaccattcttgttaatgatgacattgnnnnatgttt

SEQ ID NO: 16843 - DNA, 844 bp, Citrus sinensis
  Predicted polypeptide sequence is orthologous to G1017, G2567
ttttatcgaactctttaactattcattgccaaaaaaatttaagggaaacaagaatccgggaggattttagcttgagtacagaaaaatggatcagaggctctgctccttatcagacaaattcaagaagctaaaaaggtcagcaggatcctttcagaagggggaaggaaaaaaaaaaaaaaggtcagcaggaaatgaaagacttaaatcaaccggctgtacaattgaaccaaccaacgtttatttctatactctacactcctacattgtcactgcctgaatccattagaatcgtcaatcttctagccgttttcataaagtcactgaatggttcgtctcctatgtgcttcactgcaccgttaacatcacggtaaagcaagtggcttaatgtctcggcattttctatgccaaacatttctgctagctttttgtacagttcgtcgtaggatccgagcaaagagaggtcaagagtgcgacctacatcctctgattccatgaatactttacaatgaccagtctctaaactgggctccgtttcttggcggttatccttgtaccactggaaaacttcatagaatgagcgatcaggtaagccttgttgttgaagtgcagatccagaaccatcagaaaaattcgtcaacttatctaaattcccttctgatgagctatttccagtacgaactggtgaaactgtatcaccggaacagctgtgagacatctgctgctctgtaagtattggtttcccaaaaagaacaagctggggtgtctttaaatcatcagctttctttgaaggctgggttgaatgtgacatggttagcaagcaagaaatgttctcactcatgcttgg

SEQ ID NO: 16844 - DNA, 900 bp, Citrus sinensis
  misc_feature (32)..(34): n is a, c, g, or t
  Predicted polypeptide sequence is orthologous to G1020
gcggggcttcaagagctaacaaacaacttgcnnntctgttcaaaatggctccgagagataagctcaacaaaccatcctctaacccgaatccgaattcgaaggatatggagatccgatacagaggagtgaggaagcggccgtgggggcgttacgccgccgagatccgggacccggggaagaaaacccgcgtctggctcggcaccttcgacaccgccgaggaagcagcacgtgcctacgacgcagcagcgcgtgagttccgcggcgccaaagccaagacaaacttcccaacgccaaacgaaatccttggcaccctcgcccgcagccccagccagagcagcaccgtggagtcatcctctcctcctccgccgacgctgctgccacagccacagccgctgccacagctaaacctagctctcaacagctaccgtaatgccggcgcgtgcctcccagtcgccacggcgcgtccggtccttttcttcgacgttttctcctccggtggtactgttgcgactcaccgtgatgcacgctgtgttggtttttatcccggcgggacccagagcgactccgattcgtcatcggtcgtcgttgattacgatcctcgttcgtctgagagaagattgattgatcttgatcttgatcttaatctccctcctccacctgaagtggcttgagtttttggactgaagctaatgctgacgtgtacggcgatggtgatgtgtatatagtgaccctagcaagatcctttggtcgatcttcgtatttttgtttttgcaactggaaaatctaggacggttactccacgttgtttttaactgctgccgttagaaatatatatatatatgtgtttaatgcttagtcaaatgatataagagaagtgagaacccttttttgaaaaaaaaa

SEQ ID NO: 16845 - DNA, 886 bp, Citrus sinensis
  misc_feature (13)..(15): n is a, c, g, or t
  Predicted polypeptide sequence is orthologous to G1020
gggggcgtccccnnntccttttatgttttgtcactcgctcaaaacaacaaacactacccacttgaaataaaaatataatacggaaataatatggcgccgagagagaaggcgtcgggacctgtaaaagttaacggaaacagtaacggtattgttaaagaggtgcattttaggggcgttagaaagaggccgtggggtcgatatgcagccgagattagggatcccggcaagaagagccgtgtttggcttggaaccttcgacaccgctgaagaagccgctcgggcctacgacgctgctgctagagaatttcgcggcgccaaggctaaaacaaacttccccttgccttctgaaaatgtaaccaacaaaattagtcacaacaatatcaacatcaacaataataaccagagccccagccaaagtagtaccatagagtcttcaagccgcgagccggctctgatgatcgattcgtcgccgttagatctcaatcttggtccggcttgcgccggcggtggtgccggtggaggatttaacgccaccgttcggtttcccttccagcctgtggggggtgctttcggtgcggcgaaccaggtgttttattttgatccggtagctgcgatgaagagtcagcagtatcaacggctcaggttcgaccatcaccggaattataattttcatgcggcggcggtgacggcggtcggtgacggaagtgtgcagagcgactctgactcatcatccattgtcgatttgaaccatcacgatgataagccactcagagttcttgatattgatcttaatcttccaccggaagatttcgcctgatacttttgccgatgaatacacgatcatcggagatcgtcggaaatttcctttcatgatcatatttttagcg

SEQ ID NO: 16846 - DNA, 740 bp, Citrus sinensis
  Predicted polypeptide sequence is orthologous to G1023
tttttttttttttttttcataataagttcaataatattagtaatgataataataacttaaaaacacaaaatgagagatgcgaggcaacgatcaaaactctcttgaacattgaaactcgaatgaaagaaatagagaacccaatggacggctctaatagcacaggaaaacccagaggattcctctaacctttaaactgacaaaaaattgagatatcattcctcagcatctctctctgtggtttctcatcgagaaatcaatcaaatttaaaactcactcaaaaaaccacttcccaagaaccaattttacagtccctgagatattttctcacctctaaaataaaactaaatactaaatactaactactggctgcaaaactcaaaacttaaacgcaagcaatgttgaggggagcagcttgttcttccagagaaccaaaatccaaagtcccaaactcaaactcgaaatcacaatcaggcagctcactaggctcgtcaccatcgacaccggtaaccttaaggtcatcgaggctgcagaaatctcccgcaggcatcccacagtcaatgccttcgctgaagaaattgttcaactcttcctcaattgaactaccacctacaaatgtctggtccatgaaaccaaagaagggtaattcaagctcggcgaaattagtgtcaaacccttctttgaacaaatcacccttctcgttcacattaacatcggcaatgttaatgtcattttcctttgaa

SEQ ID NO: 16847 - DNA, 799 bp, Citrus sinensis
  Predicted polypeptide sequence is orthologous to G1033
cggctctgcttttgtgttcttcgcttctcttctatccgtccaggcatatcgcttctgaaaatgaaggttaccaggggcaaaggagcagtcaagaaggacaaaaatgaagtagtgaagcctgttgaggacagagctgcaggaaagcgaaaggctgtgcttaaagctagtaggagtagcaacaagcgcaccaagaatgtcaagtcagcaaagaaagaccctaacaagccgaagaggcctcctagtgctttttttgttttcctagaagagttcagaaaggtttacaaacaagagcatcccaatgttaaagctgtctcagctgtggggaaagctgggggagagaaatggaagtcgctgactgatgcagaaaaagccccatttgaagcaaaagcagcaaaaaggaaattggattatgaaaagctgatgacagcatacaacaagaaacaggaaagtactgaagatgaagatgaagaggagtctgagaagtcaaaatccgaggtgcatgacgacgatgatgatgaagaacttgaagaggaggatgaagaggaggacgacgactagattcaggagcgccactgggtatagttcctttgctttatccagaaaaaatcctggacgttgtatgaccatgcagttgggttattttgtgtttttaactataaaagaattcaactcttcgttctgccaacttgtaatgtaatgctggtactgcattcatctgcagtctgcatatatacctactgttttgagtaatgttttatatatggttacagaattttgtatgtaaaaaaaaaaaaaaaaa

SEQ ID NO: 16848 - DNA, 850 bp, Citrus sinensis
  Predicted polypeptide sequence is orthologous to G1043
ttttgttattccacaaaagtgattatactagtgtacaaggaatggccagtgggttgactgtgcttaattgaactttacaagaatcctaaaagattccgctgtcatcaaaatgaaacccatgctcaaaatcattgtacatgtccaagctatgagaagagatcatcttgttattgttacatgaaaacaccatggctgctgcttctggctcgtcagatgattgaaaagaaacaaaatcttcccacacaattgaatccagagaggacaaatcttgatgatctgtgcttgttgtctcttccttgcattcttgtttgatttcttctgtcgggatgctagacgaggaactcactacaaaagaaccaccagtgctaatagtactaccccaattaggctcagaattttcggccacaatttgtgggaagctgataatatctctgcaggtatgatggcctatgtatgttgtatcatacatttgtggatcatcatctcttctttgaacttgtttcgttgcccggcagccctgcacatacttgtgcgtacacctgaagtagctccttggatgtttagtattgaggatctccttttggccatattttctccatgcatgaccatcattactggttgaagaaactactgtccatgtttgcgaatttttctttctcttgtagcatcctctcttactgacactgtccttcgccgccggtctcttcttactctccccggaatcttccgatctccggcgatagtcatcggaattaacattacaagaattcgcctgctgctgctgatacttctcatgatcatcatcacaagaagaagtagtaacagtagtaccgagcacagaaagagtctg

SEQ ID NO: 16849 - DNA, 870 bp, Citrus sinensis
  Predicted polypeptide sequence is orthologous to G1048
tttttttttttttttttagtaaatacgatctaaatattatgaagaaagttccatcacatcacatgccatagttctcaaagatagagctactttgacttatcctataacataaaccattcagtagcattttcgcttctaattatatagaccctttcaccatcctctcatatcctgaaatgaaaaaccaaaacttggagggggggaaggcattctcaagccaaaacactaagcgcatgagaagtcattttcatctttctccttgaagctttgcatctccgagacttcaccactgctaatagataattcttacttcctgcttctctttgaactagatttcctggagccttttcttccacttgaaccaggggtactgactccagatgtgaccagatgggtttgggcagagtgaataggcacatgatgcccaggaaccaaagcagggaacccaacagcagggattccaacaagagcacagcagactcctgcttggtcaaggatgcaccatatgcattgcccttttgcaaactaaatctaagggattgattttctgcaagaacacagtgaagcaaccgcccgagtttcctgcattcactttccaagtacctgctctttatctccagatccttcacatacatcttcttcctctcccttgatctgactgccgcatccctatttctcaactgccttctccgtttcttggagatgggatcatcagcattatcgttgtcagtgtcgttatagtttttgtcgctgttgttgacctctggttcatcgagcaccttctcctcagccgggctagcattaccagattcatcggcaccgttttggtccttgtcagttggcagctcaatcacctcagcaccagaagca

SEQ ID NO: 16850 - DNA, 850 bp, Citrus sinensis
  Predicted polypeptide sequence is orthologous to G1050
tttttttttttttttttctttagtttaaataaacaagagttggaaaagttttaagttcaactcttctaatgtcatggcaaaaacaaaatatgtccaaataatgtctacatatctacctgatataaataaaccatataatcatgataatataaatattattgtttgtattcgacttaatagcacaatccgagatggatatgaaatgcaaattgaacttgtaatcaccatgccctcatggacttgttggtggagatgcaagcaaaagtaatgaatgaatgcactggaaaaactaataccgaacatgaatgtaaagaaaattcgtaaaatatgtaaacagggagagaaaacctttccatcttcatgacctattgattcgactcaggttttgtggccgtgccacagttctgctgctgctgctgaaagttgacttgggaatgaaattgctgatgctgatgttgcaactgatggatgttgagttgggaaggctgctgttgatgcacctgaaacatctgggagttcatgggaagctgctgattggccatgcccttggaagggtcaaattcactagccatctcttgagtagcaactttcagccgtcgtacctccgcagttaatgcttcatttagagcatctcgaagctgtgcctgttgctccatggcttgaagtcgaaacttcaattcattattctggtttgtgagcccaactgaatctctctgtaaaagcgtaagctgggcagacaatgtggtggcttctgtctgtagtgtttgaaccttgtgctccagctcggaaatataacgcatcttcctctctttggaacgagcagctgactgacgatttgccaaaatcctct

SEQ ID NO: 16851 - DNA, 707 bp, Citrus sinensis
  Predicted polypeptide sequence is orthologous to G1050
gcctgctgtgtctctgtctcttcgccatttccgtcaagagcgtacaagattctggtggtttgatctgtggtgtcatctgggttttggttgaattgaagtgggttagttttagaatcgagttttatttataagcttttgaagtgcttgcttttagtgtttttcttttcattggcattatatatttttagcgttttaaaagagtgaaattttttgagagctgaaaaaaaaaaatgggtggtgatagtaatgagggtaatggtggtaatactgatatgatgcaaagaattcagtcttcgtttggtacttcgtcgtcttcaattccaaaacagcaaactttactgtctgcaaaccaacttgatttgcctcaattgaaccaaaatcaactacgtgctcgccacttttcacagtttgcaactaattttggcggtgatagtagcaaaagagttggtataccaccttcacaccctaatcaaatcccacccatttcaccgtattcatcgatccctgtgtctaggccgggtaaccagcaaatgggttcgcagaattacagcccggggcctacccattcccgatctttgtctcaaccatcttcatttttttcactcgattctttgcctccgttaagcccgtctccgtttagagattcacctagcacttcaatgtcggatcaagtatccactgatgtatcaatggaggatagagatggg

SEQ ID NO: 16852 - DNA, 903 bp, Citrus sinensis
  Predicted polypeptide sequence is orthologous to G1062
acaactctaaatatcataccaattcatagatgcaaccatggatccatgataccattaccctaccaccaataaagccagtaatggcaaatacacctaaagtaaccgaaaaggagattttattctacgagctgaaattacaaaagaacaacacttgagtttctgtgctttctgaggcatgactaagaacacaactgtgaaagatgcttacccaaactaccaattctccaaacatatgatgactgatgacctacaagcatcagtctggtcttgttcgtacctctacaaaatgaaaatgagaaccgaatttcatttacatactacttgaggtacagaagaactacagttagtttcttcactcacaaggtggttgaatgtacagctattcgattttacatcacatcatggaagccagctgtatccaagagcaccgatttgatctgcttgggcaagacatcctggccttccctgcattgctctgctcggaaaacatccagtgcaaacccattgaaacagctgatgacagcctgctgaatgtccaacccaaggctgtccagagccctcatagtagagagcaagagacccggcctacgagcgcagaacatgtgaatgttcacagcccttccttctctaatcctaacttccacccttgcagcttcgcctgttggactccggcttatttcttccttgacgcggcacggaagggtgggtggagttggggtcataggttggatgcttgtagagggctgcatcaaagagccaggtggggttgactccaattcattgtgaagatcattgatcctctgcaggagttcctttaggtaatcaatggcatcccccagtattgaagccctatccatcttgctaatcttgggcacaacagacctaagcatgtaaagcctatca

SEQ ID NO: 16853 - DNA, 752 bp, Citrus sinensis
  Predicted polypeptide sequence is orthologous to G1078
ttttttttttgaccaaaacaggatatcataaaaccacaaaaaaagaatccacatatttacatatcaactccccctttcccaccaaaaagagaacaaaaactgcaataattataggagcctacaggcaaaaattccaactcttatgaaattcaactttaaaaaattcaagtggaaaaattatggtatatctatttgatagcataggaacgagtgcataccatctcaagtgcttcagtaaataaggtagagaagctggtcaatgcctgaaaaacccctggcaatcctgtctgaagattgttcagtgtatttgctctggtcacctctactgccctggaatgcctcagcaactcatcttccacccgcctttgacaggcggcaagctccaattttttctcagcaagtgggtctcgagcatctaatacatgtccattatcaggcccaggatcaggaagcccaatacctaccatggagtatgaatggtagaatttcctttctatgttacgaagagatgaagccttcttctcaagttcctttgatgcagtttcagttcgctttttaatcttcagctcttcagtttgttttacagatatcacatgaacaacatttatgaagctcttgatggcctcggaagcaactgtgtccggaacacgctcaagagcaagcttccactcatcgaagaaaccatacacctcagaaggttcccttttaccactcatgttgtcattgctgacagggataagggtgagcttgaa

SEQ ID NO: 16854 - DNA, 787 bp, Citrus sinensis
  Predicted polypeptide sequence is orthologous to G1089
atttagatcactgattaaacgataaaatgggctgcacgcaatcgaaaattgagaacgaagaagcagtgacacgatgcaaagaccggaagcagttcatgaaagaagccgtgggggcccgtaacgcttttgctgctgcccactcagcgtatgccatggcactcaaaaacaccggtgctgccctcagtgactacgcacacggcgaggtccagaaccctcagctcgtagccggcgcaccccaccagccttctgcttctgctgcggtggcggcggcgctccagcctccgttagatcctctcctcccgcctcctccgcctccgtcactgaccacttcgccggcgccgattcagcgtgcggctagcatgccggagatgataaagatacagaagactcgagagaatggcgtgggaccgacgattgaagaggagaacgatggtgatgacgaggaagatgagattgagagtaatgagaagttgattatgaggaagagaagtagtgggagaaatcggagcggggatcatcagaagaaagaggaagcaggtgtgcctcaagagcgggcgcggccaacggaggttgagaatagtgagtctatgcagtcgatgggaaattggaattatgattattttttccagacggtggatcactatccgggaccgagtttggaggtgaaagaggaggaggttatggagaataatgagagcaaggtgtttgatgaaattcctaagagaaaagaaaatgtggaggaaaagcggaaggaggtaccaccgccactagtggtggaggacgtggc

SEQ ID NO: 16855 - DNA, 712 bp, Citrus sinensis
  Predicted polypeptide sequence is orthologous to G1100
gaagttctgggttctgttgaatttggagaatcaagtagttttgtgattaaaacaaaagaaaagttaaacaaaaatgatttcttcagggatgaatttggtgatgacagtgataggattcgctgtgagcatcatgttcatagtttttgtgtgtacgaggcttatctgcgctcggattcacttgaactcatcaagaagatcatttcctattgcctctagatctgatcttagccttctggaaagagggttacatggtgttgaacctgtagttgtggctaactttccaatgaagaagttcagtgatgagtattttgcagctgcagaagatactcaatgtgctgtttgccttgcggaataccatggtgaagatacgttgcgcattcttccctactgtggtcactccttccatgcaacctgtatagacatatggttacaccagcattccacatgtccagtttgtcgagtatcattgcgtgaattgcctgagagaaagcgcttgatgcaacctatctttagttcagctatccggtctcattatggcacagaatcttttgatacacattcatataattatttatcggggcatgggttttcatccaggacggttgtcaaccgtgagatggactccgttccagaggatcattgtgcatcggatgatgatataacagattctggggggaacatctccccaaccaccgagggtaaccagacgaca

SEQ ID NO: 16856 - DNA, 872 bp, Citrus sinensis
  Predicted polypeptide sequence is orthologous to G1134, G2555
cgaattagggtaccgcggcccccccttttttttttgctaacgagactgataataaattattatcgtgtacagcacttttatagccataccaactgaacttcagagagcatgaagttcagttctttgccaaaatgaaaaagtcctgatcatgaacgccatggctatagttccatatgactggcaatcttccaaatatagaggaatagttagtgataaagattgtgccacctgttgttgcgaggctgatctcttggagggtaggaatcataggatattatcgccaaacaaaccatgatggactttaaccttgtatatatagttacaaatttggtaacttctcagattaatcttttgccgagcatttgcatctcctctgatgctctgtgagttcctcaatttgcttttgaagaaacttgacatattctactgcctcctctaacatatcagcggtgtttgtttgcttgtccatgttcggcacaagatcctgaagcttcctaatacggtcactgatccgcgtcctacgaaccctctcggcaatacttcgaggatgagtggcacaaccacgctttgcacgaaccctacaaggcactgaatcctccaaaagtttctccatatccatatcaaccaaatttgaaacaccaccaggtacctgtccactttgctccactttcaagtgagagtgaaagttcagttttgcagttggagatggaaattgtgtattgttgtcttccctagctctcttattggaattaggagaaacatcgacataatcgtaactcgatggagttgcatagtttgaaaagtacccatcaaataaatcggcaggggagctgttctgccgctggaaaccaacttggtccagctgactctga

SEQ ID NO: 16857 - DNA, 778 bp, Citrus sinensis
  Predicted polypeptide sequence is orthologous to G1145
tcgcgtaatacgtggaatccagatgtaacagcaacaggcagcagcttgcctaagcagggaatcttttttgtcgattcaagatcagatcccccagtttgtggagctgaaaatttcgctgaatggggattcaaacaatggggtctcaaagtaatggccaacagtctcatttacaaccttctttggtgaggcaaaactcgtggtatagtctcactctcaatgaagttgaaaaccagttaggaaatttagggaaaccgttgggtagcatgaacctcgatgagcttcttaaaagtgtctggagcactgaagcaaatgattccacagggatagacattgagaattcctccacagcgtcatcttctctccagcgtcaggccagcctgacattggctagggctttgagtggtaaaacggttgagcaggtctggaatgaaatccaacaaggtcaaaagaagaggtatgggcaagagatgaagagccatcagagggaacctacgctaggagaaatgactttggaggacttcttggtacaagcagggctttttgctgaagcatctgttagtcctatggatttggacacggtcggggtggtgacaatgcaaagttttcccgaaaagatgagcttatcaccttcctcttcaattgggacattaacacctcggcggaagagagatgacaatgcattcgagaagagtattgaaaggaggcttaggcggaagataaaaatagggaatctgctgcacgttcacgagcaagaaaacaggcctatcataatgagctg

SEQ ID NO: 16858 - DNA, 754 bp, Citrus sinensis
  Predicted polypeptide sequence is orthologous to G1145
tttttttttttttttttacgatagaaagaaactatatactgaacattttgtaagaactcaactacacagttttttcggcaaatcttaggagacaatggtgacaagtaccatgaaagttctaatgcaactgatatcacagagaagtaatcacaggaacaagaagcagtctattagcagaagcaatagacagctgcttctaaaagatccattcatataggacatgtttaactttcaccctcaaagtaaactaaaggaaacatcgtcatatctacaaaactttcagatacagagactgtgtcagaatggggatgatgatgttctccgaagctgatactttggctgaggtggtggagcactgaacatcttctccagctccttctgcttccttagcctttcattttcctcttccagacgagaaactttgttctctagttcatttgtgtaagcctgcttccttgctcgtgaacgagcagcagattcccggttctttatcattctcttctgcctcctctcaacagtcttctcaatcatatattctgaggcgcctcttttccttccaagtgattgtggatctgatagtgttcccattgagggtgaagttaaggccacctgattctccgggaatgaaacatccattactgcaccagtcaccatgttcattggctgcggtattggctggcctggcatataaactcccatcatactttgttgtgaatgctgatattgtggatgtgggtacggcatccacggacct

SEQ ID NO: 16859 - DNA, 886 bp, Citrus sinensis
  Predicted polypeptide sequence is orthologous to G1146
attatatctaaattacaaggttggtggccttctttatggtgaagttcccacaggccatttgcccgcaaaacattcgaaatatgcaaacatttggacatataaacaattaaacatgctgaattaatattttggatctttgtaagtaatgcaaaaaaaagtgaggttgggggcagacaatatttacgtcatgtattaatagaaatgaaaacaattattcccaaaaaaagtcacttagttcaacgcacgggcttaagttgaacaagccattttttgttgttacttcatgattgtagtaagctgatggtagtagatcatgctccctgattattcctccatgaactaaacctttctgaggatcttgaatagatttatagagatctcagataatttcctcattgtgtgactgggcagagacaactcctctgtacttgattacttctggccaatacatcgaggccaccacctcggtttagcccagcactttcaacttcattaaactattcacttgagcctttgcagttgttcccgtttcatttgaaaagactgccaccattttgtgcatttctttttccaacttttgatataaattgctcatgaagtcatcttcctctgaatactgtatgacaatgaactgttgcgtccgatcgaacggctcatcaacagatcaaacagactttttccaacccttttccataaattacatttgcctaattcctaaagtttcggctctgcccaatgtcggccgtagttggctgccgcagagatgtattcgacttcaatttctctacagcgatttcaaatttacttcagcctcatacgaccgcactcccattggcaattaatttcattatccgattttactatacgtggaacagatttgagcaat

SEQ ID NO: 16860 - DNA, 830 bp, Citrus sinensis
  Predicted polypeptide sequence is orthologous to G1146
ttttaattttaacattaatataaaataatattatttcattaaattataacttagtacaatataccttaatgcaatacaattaacagtgtaatgcaatagtgtaaaagcacaaagagaacgttcatatcaataatcagatgtttgatggaatacgggaatcccaacaaacaccattgtagaagcatgctcctttaattttacaacaaaagttaaccatgatcagccccatggatccaagccttccattcatcttttgattgcaacctgtttagtaaggtccagtccaagcagcacggcacaaaattcaggtcacaattgcacaattaaaatatcactggcatccattacagacaagtatcgcatgcaatacactggaaggcaaaccatctatggagttctcaaaatagatctaaatcttgacatccttggctcatcagggcaaatgtcgaattcttatctcatggaaaggcaaccctaacagtaaaacataacccgcttgacattctccttcagggcaggaaggggtctgacagcagcaccaactccaggtccacgtgtgctccttgcaccgacccctccacccatgcctccacgtccaatagttccactggtcattgaaccactgtctgatgtctctggctccatatagaaacgagctcggaatgctgcaaggtgggcatagtatgctgggggaacaatggaaacagaacgagtgcacctagcatatgtgtagcagaggttgtttgtgagggactgtagtccatcagctgtaaacttgttctcatcccatagaacatggtaatgggcaggacggcttgtaccctgtattc

SEQ ID NO: 16861 - DNA, 950 bp, Citrus sinensis
  Predicted polypeptide sequence is orthologous to G1146
ttttttttttaaccaggacaatatgcagctaacatttttaaaataaggagaatcagaaacatttttaaaataagaaatgaagttttttggcatttaaatttacaaggcattaaccaggacaatatgcagctaacattttaaaataaggagaatcagtttctacccttgatgtccaatttgaaactactcccaaaataacagtactgtccaaaaagggcaccacgctggtactccatataccaaaacacgtcaagccttgatgaaaaccatgacaaagaggattgatgctggagactactttcagcagtaaaacattacatctttcacattatccttgatgacgggaagaggccggatagccaaactcccctccgccgtgctcctagtccctcctgtggatccacccgcagatgtttcgtcttcgatataaaaacgagcccgaaaagctgctaaatgtgcataatatgcaggaggcactattgaaactgatcgagtacaccttgcatacgtgtaacacaagttatttgttaacacttgcaagccatctgcagtaaaacggttctcatcaaacaatacatggtagtgagttgggcgactggttccctgaattcctgcatggctgttgaggtaaaaatcaaattctgtagggtgacaaatttgagtatcgacaacagttcctggtaaaatatttccactcctatccgtcagatcacgtctgttgtgctcagcaggaaaaaggcgagtatgatgccttttctgtaccacaacaaacgtaactggtggcgcatatccctcctcaagtgaggcacaggccagtcggatagcattcatttcatggagcaaaacctgactgaactgcccttcactaacaccatctcggtagaaaataatactctcaggtttacggttggttgatattttgaaggcaattaacagttccctgatcatcc

SEQ ID NO: 16862 - DNA, 886 bp, Citrus sinensis
  Predicted polypeptide sequence is orthologous to G1181, G1850
tttttttttttttttcattctaataattgagctcgatttccttcggacggacgtttcccccagtttatgaagtaaaataaaattaataactgcgacatattttatattatatactctatgatatttcatagtctaagctcaaaccaaattataattgaaagagagaacaatgcaagacgaagattattatgctattaactagtgaattatatatattatttatttcttatgagttctaaccaacacgtttccgcctattatcagggagtttcatttgacctgccatttccatccaagcgtgtcccttttttaccaaaagcaaaatccccgcaaatattcctctggcggggcccaccccccactcggcctccagaaagttcaaggaatcacgtgtcacatttcagtttagcacgtgtttgttctgacacgtgactgatcaatctaggcgctacctaaccccttttggatcatctaatcaattacacaccctctggttaggcctgtggtggctctgccgcagccacggcgtttcttgacgatcgcagtgatcgccgccgccgccgccgcccatctgataatccaacggctcggattttaactgcagctgcaaacgagtcgcgttctccgccgtcgacgaggagggttcaccgccgcagtttacctccctcgcgcgcttcgcgcctattggaacaccgaacaacctcgtactcatttcctctccctcaccacaggaaaaccgcttctctgataacaactccatcgccgcctgaccgccgccgtcaccaccaccaacaccaccacgggtgtaattagacatcaaactaaatatattgttacagagattcttcatttccgccacctgcttgttcagctgagcattctcctt

SEQ ID NO: 16863 - DNA, 871 bp, Citrus sinensis
  Predicted polypeptide sequence is orthologous to G1181, G1850
tccgcactcctttcacatccccaccttcctcggatcaaaaagcgcttgccttttaataagcaaacaatttgaccggatccgcacatatcatcacgtggccccatcaccacgtgcaccaaccatattaatccatatcgccgtcagttctcacgatttacccagttctagccaaggaggttcctgatgatgatcattattcgcatccaacggctctgatttaacatccgaccccggctgattctcaccttgctgttgctgcagttgattcttctcttcttcctcttctctcctcgcacgcttcgccccaatcgacacaccaaacaacctcggagtcagatccaactcctccgcctcctccaccttcgcgccgccttcatcggccttcctcgccggcagtatctccaccgtcttcccctccggcagacttacgttgtccagctgaccggaagcgtaattcgtcattaaagcgactccggcatcgtcgtacaactcgtagttctaatcacggtcgtagtcggcaccgccaccggcgacgaattagctgatatcacctgttccagccggagttcgccggcgaaatctaccgtgcaaccgcagcgaccgtcacagtccccgctgtggcagctgtgaaccagaacagggaaacaagatgcagcagagaaaatcaactgcgtcggggcggccatctggcaccgacggatctgatttttcgtatcggatggtcgtcgattcccgtaagttttcatttttatgataacaggatcataaattcagtatatgcatttgatttgttggtaaaatttaacaacaggatacacaaaggtggctagagggaagtctcgtctctctaaactcattttcgctcaggctg

SEQ ID NO: 16864 - DNA, 751 bp, Citrus sinensis
  Predicted polypeptide sequence is orthologous to G1190
gttttcccttacattatcatcactagcctctttctttctgtcctctctctgcctcagaaatctctgagacaagacgagacagaggacggggcttgtacctcttctactgacagaaggtaattaattgtttctgacaaaatgaagcataaagatgggaaaccgatttctccaaatggtgataaaagtcccaggattgttcctttgacagtattgtttgttgcactatgtgggttttcgttttaccttggtggaatcttttgttctgagaaaaacagagttgagattagggatgtccagaaagcagtcccgtctcccaaggatcccgcggttgctccgcttcagatcaaatctgttaacttccctgaatgcagcagcaactatcaagactacactccatgcacagatccaaagaggtggaaaaagtacggtgctcatcggctgactttcatggaacgccactgccctccagtttttgagaggaaggaatgcttaataccccctcctgatgggtataagccacctatcaagtggccaaaaagcagggatgaatgttggtacaggaatgtgccttatgattggattaacaagcagaagtcaaatcagaattggctgagaaaacaaggagagaagttcctctttcctggtggaggtacaatgtttcccaaaggagttggtgcatatgttgatttgatgcgagatctgattccagaaatgcaagatgggacagttcgaactgctattgacactggat

SEQ ID NO: 16865 - DNA, 683 bp, Citrus sinensis
  Predicted polypeptide sequence is orthologous to G1190
tttttttttttttttttcagtaagtagcaaaaaatttcatttaacacaatattacaattatcaaggatgtgacttgaaagttcaccacatactcttacatccactgatttgatcatgagttttacaccatataaaagaaacaagaaaaaaaaggggaaataagagattgggaattgggataaaaggtgggtgaccaaagaaaaggtatacaaatacagcccggtgtcgttaccttacaaagaatatatttatatcaaaatgctgtataatttaacaaaatcatattattgaatagctacaattgacaaattttgaattttaagattcttgacttctatggcacaaattaatctttgtgcgttgtattgatctttgattttctctgcttctaccaaatgaatttatcatatataattggcttcggttctccaggtgccgtatcatgaccaggatttctatattcatcaactagaggtttggttagaaaagtaccaaagttttttctggcaaagcaacaacttctccttctcaacaccgtattcagtgtcctccttatgacagctccacttcatccccttagcaatggtagcaacagcatcaataaaatagctggattcccgtactatcacatacccattgggacgcaatattctatccatctccaagagcacaaacttcatatc

SEQ ID NO: 16866 - DNA, 906 bp, Citrus sinensis
  Predicted polypeptide sequence is orthologous to G1226
tttttttttttttttttcaaaaggtccctcaattaaacaaataaatcattattatctactttacaataacctaggctaaagagtacgtagcaagtagaaaagaaggtacaaaagtaaaaaaaaaataaaaaataaaaaagagagaaagagagagagacacacacacacagagatgtctaatgatgaagcaccaacaacatcgtttgtatatacagacagacgcaaccccaaagtcaaaatgaaaagagaagcatcattcagtatatgtaatcatgaaaaattagatattcaaaactcgatccttcttcagccaggcacgtgtggtcccacttcccaatctcatctcttcacatgcacccactcaaaatccaaaaatccttcagaaaaagaacaataataataactaactgaattacatattctaataattaaaaaacacaaaaaggaacttttttaggttaacaagtaaacatcatgtggtctggcctgcgccctgcagctagccctctctggcacagccacacagctcgaagctcaagctgggctgccctctatctgttgccccaccaccaccatttactcaatttttattcttttttctgtaatttgatttttttttttcctcttccacttagtttcttctttctaacctagtcctccctaagcaattaaagtcagctgtacgtcttcaatcagtagaccagtcagctaccgttgatgtagctaaatatttgatgaactgctgctgctatctcttccgctgaccctagcttacagtcttcctcgatcttgagattgaaggagtaatgaactgtagtttctgaggaagtaatattgaggtgcaaaaaagtaagcctcagatcttcaagtgctacaatggctttcaacaactgaccaggccttctc

SEQ ID NO: 16867 - DNA, 884 bp, Citrus sinensis
  Predicted polypeptide sequence is orthologous to G1242
ttttttttttttttttggtaatgccatggcaacctccaccttaggcatccaatgaatatattttcattgacatgaaatcaacttcagttgagtatataatatatggcttacaaagcatcctgtatattcctttttacaactatccaagactactaacagagtctaaaatactactccctaacggcaatttttcaaaaagcaccagtcattgctggaaaacagctacaacaaaatatagttgtaggaaaacttgctggatatactaaaattcatttcctcctctttcccgagctcacgtagtcatccattgataattgcttccgtttctttaaggaactagggctctcatttggctgcctccccccaccacgctttgatggtgtcatgttcttggcaagcttcttttctttacgggcctgtctttctctttcatcatattcctggttttccttctccaccaaccgaatgagagtatcacatctcctagctaattcttgagttgtacgggatttcacaaaccagtcaaatcgaaataagggtgaagtgcgaaatgctgccttcagctcatcccaattgccatatccaagcttgtgaaccatgcatatcatgaaacgatcacattcttcattgtataatttccctttgttctgtccatactgaatctttagttccagccatggattcttgtagcgatccaatttcttcccaatggctttcataatctcatcttttcgagaaattctagcctctcctctttcaatattcttaataatcctatcatagtcatttagctccttgtatcgttctttgaaaactttagcgtatctttcaacttcctcctcagattttccatccatttctgaggcaatactttttatgtcatt

SEQ ID NO: 16868 - DNA, 735 bp, Citrus sinensis
  Predicted polypeptide sequence is orthologous to G1266
tttttttttttttttaacgaaaacaagaaattttgtattaaaaggagaaaaaaaaaaaaacaaatcacctaaaccccactactagagcactatgataattgacaccctaaaaaaaaaaaaattaataataataaaggaatcaggtggttgataatgaacgatgatgtttgatcaccaaatagtagcagtagcagctccacatgagctcatcaaaagttgctctagataatcagctcccaaatcttcaaacaccaccacattttgcgataattgtgaccctacagctacagctagttgatggtgatcgcgatcttgattattcattttgattttcttgttactcaccgaagatgatgatgaagatttggacttctttctgatagagtgtcgtttcttgagagccacaaccggcgagcacccatcttcgcggtggtacttcatttcttgaagagattctctgaccatatctgcaggaaaattgagggtagccagggaaccccgcattgagaatgcagcttgatcgtaggctaaagcagctgcctcagcgctgtcgaatgtgcctagccaaactctaaccccgtttctcgtggagtcccttatctccgccgcaaatttcccccacggccgcctcctcacgcctctgtatgacttgtctgatgatgtcttgcccgatgatccctcctcctccgccgctttgccgccaccataattacttgaagttgaagaagtcacttc

SEQ ID NO: 16869 - DNA, 866 bp, Citrus sinensis
  Predicted polypeptide sequence is orthologous to G1266
ctttaacttcatattaaataaaagaaactagatacacgaatcaccccgaattgctttcaaaaaatggaagcttgtacaggcataaaccgtctttggtttacatattgaaaaagaagataacgacaataactaaataaaaaaagataaagggcaagaagattaagataaggccagaaagttacaagtagttgacttattatctaattcaccaattagcgaggtcttgctgtagtagtagtagtactttcagatgaacttagcagctcttccaagtaatctgctcctaaatcttccaacaccacaaaattttcaatcctcaaattatctctctctttatgcttcttattattagtcaccatttttcttctcatagaatgtttcctcttgagtgcaaccacaggtgagcatccctcctcggtgttacacttcatgtctttaagtgattcttgaaccctttcaacaggaaaattgagtattgctgaagagcccctcattgagaaagcagcttgatcgtaagccaaagcagctgcttcagcactatcgaatgtccctagccaaaccctaatcccatgcctagttgaatcccttatttctgctgcaaatttcccccacggccgccgtcgaacgcctctatatgacttttccttggtggggttttcctctgttgttgaactcacctcttcttctttaattctcttggagcttactagtgcttctgatgttgcttccggtgtggcttctgctattagtccatagagaagcatttcttctgagtcattttcattgaatggaagataattgttataaaaagggaaagactccggtgacccgaaagaggattccgatgaggaaattgaatttggaga

SEQ ID NO: 16870 - DNA, 772 bp, Citrus sinensis
  Predicted polypeptide sequence is orthologous to G1272
tagggtactggatattatattacggcagcatgctgcaaaacagggctgtctcctagttcgccaatcgttctttcacaatgatccaaaaaattttgctgatgtcggagggggagttcttggctgcagaggattccattcaagttttaggaccactcagggaggcttgtctttgaatattgatgtatcaactaccatgataattcagccgggtccagtagttgattttctaattgccaaccaaaatgttagagatcccttttcaattgactgggccaaggctaaacggacactaaaaaatctgaggattaagacgattacctccaatcaagagtacaagataactggactgagtgagaaactatgtaaagagcaaatgttttcactgaagcagaagaatgttaaggatgatgatggtgaagtgcaggaactggaaattactgtttacgactattttgttaataatcgcaatatagatttgcgatattctggagatctaccatgcatcaatgttggtaaaccaaagcggccgacctatattcctcttgagctttgtgaattggtgtccttacaacgttacacgaaagccctgaccaatctacagagagcatcactagtggagaagtcaaggcagaagccacaagaaaggatgagtgttttgtctaatgctctgaaacttagcaaatatgataatgagccaatgctgcgttcatgtggcatttctatcagtactaactttgctcaagtggaaggtcgtgtgctaccagctcctcgg

SEQ ID NO: 16871 - DNA, 805 bp, Citrus sinensis
  Predicted polypeptide sequence is orthologous to G1272
ctttttttttttttttacttaaacatgccaatcattccaatttccgatacccgaatgcctgaatccatcaaaataacagtttaacagcccatcgctgtctggggaaatagagagactggcgaatgcatgggactggcaagagtcaacaacaccagtaatcaccacaaaaacaaaggcacagggcactttcggtttctagacctaaaattaaatagcagagattttcaaggcatcactacaagttctagacacctttgccactggatggtccagatgaaaaccaaaaggctaactatatacaaactactttgataggattctgattgacggtagaagccacacaagtgtctcaacagaagaacattgaattgcacactttctcctgcagtctaggcagctgggggacaggaacaggtccagcagatgtcatcccaccctggctagaagatgtctctgataagtcttcgaacttcatgaatgatcctacctggcttgctgccaagtgggcatagcaaattggagcaactacagaaatggctgtagtgcttctctggtacacataagaaagtgagtgcactagttcctgcagctcatcacttgaaaagccaatttcatcaaatagaacgtggtaatgtgttggccttgaagtaccaatcattccagcatgggcacaaaggtagaagtcatagtttcttggatgacagactttgttgtcaacaacagttcctgcataaacaaaaaattctcgaaagttatgtctaatgccgtaatagacttgtgctgtacaaaattatgaaaaggctca

SEQ ID NO: 16872 - DNA, 874 bp, Citrus sinensis
  Predicted polypeptide sequence is orthologous to G1276
tttttttaaattaacacacaaacttcaatagattagccgaaaagcagttttacacaagttctagtcattacaaagtgtttagccaagtactgcaagtactttccgaacttcctgaaagaaaaatgcttgatgttaatgcaactctctctcgctcttcatcaaatttaatttacttgtacatataaaagatttttcacttgaacatatgattacaacaagtagtctcggttttccttcccttgtttcccccttcaatgtacaagaaagattctttattgtgaccattttttaccactcagcttctacagcagaaatgaggcatgttggggttgatgatcgactgggtgtaacggtcgtggaccattgtgttcggataatgaaggtgattggagacgactgaaggtgcagtaatcattgaagggaatcctgatgatgctgcagtagagaagcgtggcactgcagctgacccaacaagaggggcttcaaattgccatgtccaactagggaaggaattaatattccccttctctaatgctctttcatttagtaagtgattagaaaatccaccactccagccaggaggagaggactcaataggcatagcagggttacacggtgcaggctgaacccttgctgtcgcagcaacagaattctccagttgcgtttttcttgctccgaaatcattgggcatgttattccagccgttttggaatagaaatttgctccaattgttttcatcctttcgaccatcgtttgatttcggaggagcaattcctaaatttagatcaacttcgttgtcgccctcagcagggttggtcccatagatcgaattctcatcatatgagttgggatcaaaatttgtgactgcttctct

SEQ ID NO: 16873 - DNA, 661 bp, Citrus sinensis
  Predicted polypeptide sequence is orthologous to G1289
ccaacggagagctatatttaatctgcattaaatttgaatgcactaacttccatatgaagcttgatgacagtaatcctaattgtcctatataatttcacatgctttcttgaaacttcctagaaatcacttacctggattttatggggtacttttcagaaacctcctgaggtttggtgtattctcaactagatagaaagtggcataccttaccactaaagctgaccaatctgattcagttccttgttttcttaatccataaatgctttcttacctcttcagataactggttcaaagaatattcactttaatccccaaaacaagggaatatggcagaccacgaagtgatatctgcaaactgtaaattctcaccataatcggcaaagaaaaatccttcaaaagaatatttaagcctgtgggtgacatctcacatgcaaatcatgtttcgccacctgttggacgccagaaacccttcttgccaacaagaaattggtcatggtagatgtttgtagaccactgaagtgaatgcagtactggtttaagcttgttaatcatttctaaggtatcttggaccaaaacgtatccacctggtctcaaaattcgatccatctctacagccacatctgcaatatcgcatctttgtgttacatcactaagcagaaaa

SEQ ID NO: 16874 - DNA, 803 bp, Citrus sinensis
  Predicted polypeptide sequence is orthologous to G1324, G2893
cggtaagactcgaaaaaggagtctttgttaatgttagaacccatatgtcttcttttagtaagagctcaacttcatctatttatggcgaaaatgattctgatcagctgaggagagggccgtggacacttgaagaagacactctactcattcagtacatatctcggcacagcgaaggccgatggaatttgctagcaaaacgttcgggcttgaagagaactgggaaaagttgcagattgagatggctaaattatctgaaacctgatgtgaagagaggcaatctcactccacaagaacaaatgtcaattcttgaactccattctaagtggggtaataggtggtcgaagattgctcagcacttaccaggaaggactgacaatgaaatcaagaactattggagaactcgtgttcagaaacaagcacggcatctaaagatagacgcaaatagcacgacatttcaagagattattcgatgtttttggatgccaagattgcttcaaaagatggacacatcatcatcatcatcaccatcagctttatctcagaatcctacaattaattctcagccgtttgatcatgcttttcatcatcagggatcagcatcggcacaaataatatcccatcaagttccttacgatcggggagtgattgatcatcaagaattgaattcatcatcagactcggagcacggcattggcaccagcacttcctgcatttcttcatccgaatcaatgaatttttcccaaatgtctcagttttcggagtacccaaccggtggcgaccattttcatgctagtaataatgat

SEQ ID NO: 16875 - DNA, 873 bp, Citrus sinensis
  Predicted polypeptide sequence is orthologous to G1330, G2423
ttttttttttttttaagttttctcatcactgtatataagtgggatgctatataaatacatatatataagatctgctatatcaacacatatatataaggtcctatatattacaagccatagatataactaaagataaaagtttgagccccgctaatattataaggatccaaaatcataactcgaacccatgcatataaataatcatggtgcttaatccccgttatataaccagagatcctccatactccagtagttttcattgacttcagaaggaataggtgccatattatctaatggaaaagcttgatgaggatccatattattgtttaatggatattgtggtgctgaataatcttccatggtgtatgcagcagtggacatttggcttgagcttgcttgctcattggcctctgaactttgccctgaaaatgtttctgcttgcttaatttgcttctggattctggttctccaaaaattcttaatttcattgtcggtccttcctggtagatgctttgcaattttggaccacctgttgtcttgtatatatatactaacctgtttccccacttggcatgaagctccatgatcaaaagctgctcctctggtgtaatattccccctcttaacgtccggtcggagatagttcagccacctgagccggcaactctttccggtacgttttaggccagctgctttagctagtgagttccagacgccttcgccgtgatttgctatatagttgatgaggatcaagtcttcttccatggtccatggcccctttcggacttcagcttcttgagaattgcatggagttttatccatctcttaatttacatagagaaattaagaggaggagaagaagaagaagaagaag

SEQ ID NO: 16876 - DNA, 902 bp, Citrus sinensis
  misc_feature (12)..(12): n is a, c, g, or t
  Predicted polypeptide sequence is orthologous to G1340
gcagactggctnggttcttggctggaggaggccaaagcaaggatagaattagcaagcttgttaatggcgtccaccaacccattaatgccctctctgttaatctcagttttagattcttcaatcttgagtcttctctcatgcaaacttacaaggtctctgtgtcttctcccctctctttcttcacaggactgaattgcgtcggctataatggaagcacttttggaaatagctgctccaagttcttgaggagtgcttgcacttgcagtggcggtggcgccagcactggttccctgctgatccccactacctccttctgctcctcctctttttctcctctttgccggtgagtctgaatactcactcgtatcagaatctgagctaccacatatgatctccacagcataaaaatatggaaccaagaaccaatcaatactaactgaaaatcatcacacaatgaatattgtgagagagctagaaagagagagagagaaggaaagagtacctactgtggggacagcagcttgtggttgcggtggcggtggctgcaacgacagaggcggcagtggcagtggctgtggctgcagcattgtagttggagccgaaggttgatgatgttgctgctgcagcataggaggcaatgaagctgcagcagcaattggctgaaccatatagcctacgtggggatgagaaccagaagcaactgacacgccgacgccggcgccggcgatgaccctttgaccggctcctttcttctccaccacctccaccagagcctcatatatctgaggcaacatgttggtaggcaagttcttttctttcctctcattcttctccatcttccaataagaaacgttttgagccttaatattgccatgatctgatggtgatgatgatgatgatga

SEQ ID NO: 16877 - DNA, 745 bp, Citrus sinensis
  Predicted polypeptide sequence is orthologous to G1380
tttttttttttttttaaatcaatcattcaaccacatcttctagaacgtgatcgaaaataacttcaacgattagaatacgtattgttttaacaactaatcattaagttacaacaaccccagatgacaaaaaaagaaagaaaaagaagaataaacattaagaaacattcaatcaaacgattgtaagtcgtatataatcagaggcacaatcagagatcatcaccgccgtccatcgaggccatatattcaggtcaaacggcaggactttcctgaacaacgacgaagaaaaaaaacgcaatcatcaccatcatcagtatccgacgatgaagaatcggaatcgctccgatagtcacccctgccgccgtgttgggactcaattagagccgcaacacgacgattccacgacggccttctcctcccgctggagacgtggcgtcacctgattcgctgaccggggactattgcaggactcagcggtgctactaatgctgctcgccgcggggctgatgaccggaccaatcgagtgaaaccctccattttcctccgaaatcgtagaaatattgagaggaaaattggtcttggccttggacccacggaggcatcgagcggcggcggcgtcgtatgcacgcgcggcgtcttcgggggacacggatatgctgagccaggcacggatactcttaaagggatctcggatctcggatctcggcggcgaatctgcccctgggacgcttcctcacgccttcgtatc

SEQ ID NO: 16878 - DNA, 811 bp, Citrus sinensis
  Predicted polypeptide sequence is orthologous to G1380
tttttttttttttttttctacacgtgatccaataacttcagccatttaaaatacataatgtttcaacagctaatcatcagttgaagcaaccagatggcatattcaacactaaaaatctacaatataatctaacgaagtagataacttcataatattttttttttcttttttttttctcgtcatcgtcgggatttttcccgatagaaagtaatcgactttaaaagaaagaaaaagaaaaataaacattgagaaacatacaatcaaacgattctaagtcgtttatattcagaggcacaatcgaagatcatcaccgccgtccatcagcgtcatcatcggcgaaagcgggggcggcggtagattcaaatcaaatggcaggactttcctgaacaacgacgaagagaaaacgcaatcgtcaccatcatcaataaccgacgatgaagaatcgcaatcactccgacagtcatcccctgccgccggttgcacgacgatcttcttctgctgctgctgctgctgcaaacgtggtggcgccaactgattcgccggccggggcccactgaaggattcgacggggctgctcatgctgctcgtcgtgggccggttgacctgaacaaccgagtcaaacttacaaaaccctccattttcctcccgtatcggagcgttaaaagagtccgaaatgttgaggggaaaattggtcttggccttggggccacggagggaacgcgcggcggcgtcgtacgcacgcgcggcgtcttcggctgagtcgaaggtgccgagccagacacgcgtcttcttccagggatctcggatctcg

SEQ ID NO: 16879 - DNA, 872 bp, Citrus sinensis
  Predicted polypeptide sequence is orthologous to G1380
agttccatcccacccacctatcccctctccttccttcccttctccttccatccaacacatcaaagtcactcgtcttaagtttctttcttgagaatcccttaataatatttctctccaacgcgttgaggagaaatttattctgattttttttgataaattttcaaacacaaacgtttgtaagtatagttttatttcattcattaatcatttgtaaagagggtttcaaactctcacatacatatgaggagggcgaggggagccgcgacaacaaccgcagccgccaaacaacttatagaaccgaacggatctgcggcaagaaccgccgccgcagcggggaaagagccgagatacagaggcgtccgcaagagaccatggggacgtttcgcggcggagatcagagacccctggaagaagacgcgcgtctggctcggcaccttctattctgccgaggacgccgcgcgtgcctacgacgcggcggcacgtaccctccgtggccccaaggccaaaaccaatttcccgattcataacacgaatgtttcctcttattatcctaacaacaataacgatccgtttttggatcagagattatacggcagcgttttccacgatattcaagatcagcaaattgtaaatccgcagagaccgacgacaagcagtatgagcagcaccgtcgagtcattcagcgggccccggccgcctcatccgccgcaaagatcagcgaatctgacggatggttcgcgtaggtatccacggacgccgccggtggtgccggaggactgtcatagcgattgcgactcttcgtcttccgttattgatgatgatggagatattgcgctgtcttcgtgcaggaagtcgttgttgccgtttgatct

SEQ ID NO: 16880 - DNA, 818 bp, Citrus sinensis
  Predicted polypeptide sequence is orthologous to G1382
tacaatttcttacaattccatttcagaacttgctttacacaatattgttttcttttaagaaaatatgactcataccagtttcacatttgtacaaagcattcaactataagaaattaatacaaacggcagttagaataaggcaattggtgtgtggtagcaacacataacaacaccactactagtgtcagggaactatcatatatagaacaattttccgatatggattacagcctctctttccttaccagccaaaaagaagaaagcaaaataaaccatggagattttatttcggctatgtataatcaaattcatggacctgttagtattcttccaatattttgaggatacgggtaagaagaatgatttaacggtggaaagtcaacgccacgtccttcagttggattccctctagatccatactgattcatgccaccatttacaacaccagaataagctgtgaccgcgtttgcttgaatgattttataactggaactgctagcatggggatggctatgggcaagttcagaatgcagtgcctgtggctgctcatttgatctattttcagtggcagaacttattcctacgccaagatccaggctaattgcctcgccttcttctgatataatcctgcatggtccattcccagctgatggtccagctgcatcatggctactagtccttgcagtaggtacatcatggttatgcttgccctcatatgtggttataactgcttttggatcatgtgatgctctctccacgtgttttctaacaggacatccagcatttgtgcacttgtaataactcctgcttccctttca

SEQ ID NO: 16881 - DNA, 671 bp, Citrus sinensis
  Predicted polypeptide sequence is orthologous to G1451
tttttttttttcttttaaaaataaacttccagacggccgaacacaattgcattaagaattcaggtaccattatgctcaacattttaagaggtaagaagaaacgagggggtgggggctggcgagcaaagagaaaagaatatatataacagcaaaatttcctaaacccatataataaggggcaaggaatacattcaaggtggtactaaaagccgaaaacaatctaatgaatgttgcagcagcacagtggtaacaactggtttgttggcactgttaggcataaagaaaacccataaacagctccaaaaacttgataccgacccgcttgccgccagtaaaccaaaatgtaagatgcataaagtgcgaagaagtttccaccatatggttgcttctttattgttatgatgtctgctataagcacctgcccttcattctggtccactcttattaaatattagggaaaaagaatctctgaacagaaagccgcaaataaattacactcaaaaagaaggaactctcatctcctgggccaaaatttctacctatcaaagagctctcaacgagaaatgccgacgcctctcaagcttcaaccaacgggtattatcactgtttatggggttcaaaaaccgctctgcttccacttcagaatgaagcgaggactgcagcctctttaa

SEQ ID NO: 16882 - DNA, 400 bp, Citrus sinensis
  Predicted polypeptide sequence is orthologous to G1451
tttttttttttttttttaacaaaaactttaatactataacttaaaaacaacaattggtcaaccccaatcccgcatccttaaaaaaaaaactaaacccctaacgaaattttgattttttattcctatgtttccccaaacaaaccccctcaaattacccaattgcccttggcaacaatgggccgttgattaaaaccagccatcactgggtcactgcccctcaagtcaatttgaaacaaaaatttttgggataaccctacaactcaggactcatgattcaactgatgcccccctgggtggaacatacaaaacttttgcataaaaattttggaaggggataatccccgtccctgaaacatctttcccgtaaaaaaaaaacccccaaaaaaaaacaagcataaaa

SEQ ID NO: 16883 - DNA, 613 bp, Citrus sinensis
  misc_feature (579)..(579): n is a, c, g, or t
  Predicted polypeptide sequence is orthologous to G1474
aattcggcacgaggtgttattccttctttatcttctccaattgcgcaagagcaacaacacaagagatcccctatttcttcccctaaatcttgttcaaattcggtggctgacaagaataattccacaattgtaaaatcagcgtgtagggttaaggcagattatgttaaaacagatttgtctgtgagcttgaatttggttgttcgacgaacacgcccaactttatctactggcaaggaggcagctgttggatgcaagagaaggagaactgaagcatcatcactacctttcttcctcaagccatgttcatttgatcatgataaagatcatcttcaatcagaagaacacaaaatacttaaccctagctcaattgaggacttggatcttgagctcaggcttggtgacccgccgcctaaggtaaagtaatatatagaaataagagtgcctcataatagtttccgttcatttgtgctttccttttcgtatttcttctttgatcctgaggttacagagcctcatgctttcacatatatcaatttggtctctccagtcatgaatttcaagcgtgcaaaaataacacanagttcctttttcagccaaaaaaaaaaaaaaaaaa

SEQ ID NO: 16884 - DNA, 546 bp, Citrus sinensis
  misc_feature (13)..(16): n is a, c, g, or t
  misc_feature (36)..(38): n is a, c, g, or t
  misc_feature (546)..(546): n is a, c, g, or t
  Predicted polypeptide sequence is orthologous to G1478, G1929
ggggtatcaaagnnnnaccaacttatcatctgtgtnnnatttgagtttgctacaaaatgtgccgaggaattcaagaggcaaaccaagttgttggttcctgcagcttcaaaggaagtgcttcttctaatgcaaacactgttgattttatgtcttgtgagctctgcggttctagggcttcattgtattgccatgctgatgatgcatatctatgtagaatatgtgacaaatgggtgcacgaagctaatttcttagcacttaggcacgttaggtgctttctctgtaacacatgtcaaaaccttacgcatcggtatctcatcggagctacggctgaggtcttgcttcccacaatggagagtttgatagagaaaagaaggcagtgtgattccaaggttgaaaaacagtgctcaagaaatctcaaaatgcctttttagtttatttgatcttcttttccattttgggtatgtaatttctctgtgatagggttgtaaagatggagaccaagttttattatttcacgaggaaaaaaatgggagataagggcagttn

SEQ ID NO: 16885 - DNA, 885 bp, Citrus sinensis
  misc_feature (31)..(33): n is a, c, g, or t
  Predicted polypeptide sequence is orthologous to G1480
gggactccggagaccaaaactcaaagaaagnnngaaagaggctttatttagtaatgcccatgggaattgaattacatagcgtgaaggttatttccggcgggtggagcgtggcggcgaagccatgcgacacttgcaaagcggcggcggcggctgttttctgcagagttgactctgctttcctatgcctgaactgcgatttaagaatccacaattgcatgaacaaacacgcgcgtgtctggatgtgcgaggtctgcgagcaggcccctgcggctgtcacgtgtaaggctgatgcggctgccttgtgtgtcacgtgcgacaatgatatccactctgccaaccctttagcccggcgccatgaacgcctccctattgagccgttcttcgactcggctgactcgattgtcaagtcgtcggcttttaacttcctggttccgagtgatcaaaatggcggctcagagtttactggcgccagtgaacacgacggcgtggactctgcttcctggctgattccgaattcgaaacctggaattgaaaacgcgggtgaaatgaaatccggggatatgtttttcatcgatccgtttattgatttgaatgattttgattatccgaattcatttcagaatcatcatagcgctggcatggacagtgttgtgcctgttcaaacaactaaaccggaaccaattccagctcaagctgcagctccaattcctttgatcaacaatgaaaattgcttcgatatcgatttctgtagatccaagctctcttcattcaactaccaaagccaaagtgtttcatcgtcatctcttgatgttggagtagttccagatgggaactcgatgtccgatatttcgtacacatttggccgaaatatgagcactgggtccg

SEQ ID NO: 16886 - DNA, 858 bp, Citrus sinensis
  Predicted polypeptide sequence is orthologous to G1480
caaaatccacgcggccaacaagctggcgtcgcgccacgcgcgtgtctgggtttgcgaggtgtgtgagcaggcgccggcccacgtcacgtgcaaggcagacgctgcggcgctctgcgtcacgtgcgaccgcgacatccattccgccaacccactggcccggcgccacgagcgagtccccgtgacacccttctacgactcagtcgactcctctgccgtcaagcaaggcaacggcggagtagtcaacttcttagacgaagaccgctacttggaccacgtcgacgggagaagcggtgacgtcagcagggaggaagcagaggcggcttcgtggctgctgccgatcccgaaggtggcggatttgaacacgggtcaggcgcaggagccgtatgtgttcccggatatggatccgtatttggatttagattacgggcatgtggatacgaagctagaagcccaggagcaaaacagttcgggcactgacggtgttgttcccgtacaaatcagaaacgttaacgctaacggccatttggtcaacgatgcatgctttgacctcgattttccaggctccaaatcttacggttatggctacaactctcactcgcagtgcctcagtcagagtgtgtcgtcgtcatcgttggaggtgggagtggtgccagatggaagtagtgcgatgacggacataacgaatccgtacggcaaaggagtgggggtggaggcagggaatcagacggtggtgcagatttcggcagcggatagggaggcgagggtgttgaggtacagagagaagaggaagaatcgaaagttcgagaagacgatacggtacgcttcgaggaaagcgtatgcggagatgaggccgaggat

SEQ ID NO: 16887 - DNA, 326 bp, Citrus sinensis
  Predicted polypeptide sequence is orthologous to G1480
tttagttagtgcacacatttttttatactccaaaatgagaaacgttgaattagtacctctcttcgtcactgttgccgctggtgtcgttctcgctggatacgctggaatgagaaacttgactggacacaacgatattgtcattaacaagggacaaccttaccaataccaatccaaggaatccccaaagtggagagacagagaaactaacctcaagaactacaagaacaactatcacccagaagaaaccaagctctaaactgtgtgatatttcatgtacaatgttaaataataaaagttcctaaagaataaaaaaaaaaaaaaaaaaa

SEQ ID NO: 16888 - DNA, 857 bp, Citrus sinensis
  Predicted polypeptide sequence is orthologous to G1481
tttttttttttttttttgacccggaattaagataacatggagattaatttttaaggtacaaactcatataaacatcaaagaacattacatgaaagatattgaagaaaggatgtgaatctttaggactcaaaaagagacaacatcgatcatcaatgtaattagacttgaactagataacttaaaagtcaaatacctcatcatcttaagcagctattagtcaatgaaaatgccatcaacaactccctgaaatttgctcttttttttttttttggcccatgagatgtgatgaatcattattcttgatatctcaaaaaaatggattgattaactatattggtcttcgatcttgacgctgcttcacttcttttttagttcaacattagcccagaaggtactaaaagcaagccgagatatacatagatgtatttcaaaagtatggattcttgctttgttgagaagatgatgagtacccttgatgataatcttgacgagaatgaaactttgtaatctcattacgcacatgcttcaaagagaatgacatctgggattcagaataagtgccctctccaccattacaaaacttacttgcaaattcttgatcacttgttgaagagcttgaaacttgaggcggcggtgtcgatgaccatggcacaacttgattttcttcatcatcatcatcatcatcatcttcatcacccccatcatcatcatcatcatcatcatcatcttcttcattggcatcatcataatcatcatcagtatatgtttctccacgattcgtttcttctctagaagtagaaccactgccgttaccaacacaaacattgcagacagatatagtggggccgagttttggc

SEQ ID NO: 16889 - DNA, 409 bp, Citrus sinensis
  Predicted polypeptide sequence is orthologous to G1483
ggcgaaggtgctgtgctgcgccgacgaggcggcgctgtgctgggagtgcgacgacaaagttcacgccgccaataagctagcgagcaagcaccagagagtccctctctcctcttcttcgacacaaatgcccaagtgtgatatctgtcaggaaacatctggctttttcttttgtctacaagatcgagccttactctgcaggaaatgtgatgttgccatacacacagcgaatagctatgtgtctgctcatcagagatttttgcttactggagtaaaagtaggtcttgaaccagctgatcctggtgcttcatcttcctctattaagtcactatctggggaaaacattttggacatgaaatcccattccctgtctagaagggacgccctgatgccagtggctgctgaatgcaaa

SEQ ID NO: 16890 - DNA, 901 bp, Citrus sinensis
  Predicted polypeptide sequence is orthologous to G1493
ggtaatttcattttattctcatttccactgcaaaccaacagcaaaatcatatcaagcactgaagaaacacaaaagaagaacattcaaagtcaactacatgcagtaaaacaccccaaatggatgggaaaaaaaaatatacaaagaacacagaaatgaaattataaggcataagacaagaagcttgaatagcggttgagccattagcatgagtaaatggctactctggccacttgggtttccatgggcactggcttgcatgctcaagctgcgaagggattgagcagaatggtgcaaattgagaagttgtttcgaatccatggttgttggaattccatgtagtaagttcatttgtttgcaactgctcatatgttgtggttgcccttctccaaatcttaacttctgattatcaaagctaaaaatgttcctttgatcaacaagaggcattggtaacccaggctttgcagctgaccttgcaagtcctgctgcttgaagtgtggcgagactttgagctggaatttgaccagtggcagcaagagtttgaaagtcaagcccactaagcgaagacagagaaccataaggtggttcttgggaatgggaactgataaatgaattgccctggtgcggtgacactccacttagtcttgtaagatacagacgatatttctgaaggtggctggcaacattttctctagtaagtccaggaacattcatcaactccagaattttcttaggaacagccttgtcaatgcctagatggttaacggcagacacaaactgttgatggagctcaactgaccaaactacacgcggcttctttaaagtggatgtatcatccctctcttccatttcttcttcctcgtctttcctcctctttgaggttctccaatttccttcatttgct

SEQ ID NO: 16891 - DNA, 794 bp, Citrus sinensis
  Predicted polypeptide sequence is orthologous to G1499
ccgaaagggaagagataagaaaagaaggaataggtggtatagctcaaaggaataggtatagctcacatcttaagtatagttagttccttgaatgacttattgagaagctaggccctttcctcactctcttcttaaggctagatctgccttattgctattatttattattagccgatatggagactgtagtatcaagattagagggaggcggctttctctctctctacctctagtcaaaaggcgattgtggacaagagaaagggtgaggaacgaacaaggagcggaggaaaatgaggcctaggagaggtgcgaatcagagctagaagtagaggccgatgggagcattcattcctcagagaaaggagaaattccgcatcgcataagacccgaattggccgatctcaagctaatgactagcctatgcctatagatagatcaatggaagactctctttatcttatagaatttgactttgaaagtagagtgtaaaacatcctctgccttaggcataaagaagtcaatcgtttagctttctttttccgtctgtctttttcttcttcgtgctgctggtagttttgaagggctttgtctttcgatgtagttcctttgcttgggcttcttcacgtgacggaagaaagtaggttcataatgagaaagggatttgctcaagctgtttccattgtggtcggttctactgctattaccactgctgctgcacccttatcccaaccaaggtggtggttccgctcaacaactattctgatttcagaaaaagactatcttatgaaagatga

SEQ ID NO: 16892 - DNA, 800 bp, Citrus sinensis
  Predicted polypeptide sequence is orthologous to G1504
gcttgcaggaattctggcacgaggcgacgacctgcaactttgaacccacttttcatttaccctttcatatcctccacttcctccacttctgaggattatcatcctgaaactgcttctgaatctgggtcggagatgaatctcactgagaagcctgttaggaagaagcaaaagaggaaaaagaacctgacggtgctctcaggttccagggagaataagaaattatcctttcagcaaacagatacacctaggaaatgcatgcattgtgaggtggcagaaaccccacaatggagggaagggcctatgggaccaaagaccctttgtaatgcgtgtggagtccgctacaggtctggtcgccttgttccggagtaccgacctgctgcaagtcctacttttgttccgtcattgcactccaactctcacaagaggattatggagatgagaaacaagggtaggttgtaaaccatcaaactgctgcaagtcctaccttttgactcagaactaccgcgagagggttatggtgatgaacagtgcaaggcggtagactacaacgattttgatgaacaatgtatcaccaggcacattaggaaattcatttgggtagcttcttgtttgattatttataggacaacaggctcttcctagttgggagctcacttgtttctcttttctcttcttaatgttttgttttagttgattggttttgtacattaatagaataagacttaggaagttaggactaggagagccttggtgagcatatgtttgtcattatgaaaaggcattaggtagagagaatggaa

SEQ ID NO: 16893 - DNA, 891 bp, Citrus sinensis
  Predicted polypeptide sequence is orthologous to G1510
ctcgagaaaggaaccacagacaagttattctttctcctatgttaccgcctatttcgataagatagggatggacaagctctgagagagagctataccaaaccaattgtatggatttcgtaatccatgtcccacgcctcctcactcgggagtagggtagggaaagctcaaagccagtgagtctacggtaggcagggaggagggtggttcaatcaaaggcagtgaaaaggggttgacctgacttcggttatcgagataagaaaaggaatagcgcgctgtagtttaggtaggattcgccgacggaggatgagcgacctgggagtggatggacgatgctagtgttctttatggtgtagttgcgtcaaggcgccaagagcaaacggaggtcactacacgtgctaagactaaacttaaaagaaagtgggcactcgtttcgttggttcaactcctctctcaaggagaagcgaattagcacctactcgaacggttcactctcggtcaaagaaatgctttaaggaaagctgaagtctaaacaggtaatccaattgaattgatagcgagccaggaaagtaagaaatagtacgttgtacgttggtaggaatttagaatcgggataggagtaagctcacttcagtagatagagagttgctcgtcgtcacgaagtatctcataataggcaatgtcgcttaaaaagaaagagctgttcgaacccgttcgtgggtcagttcactttcgcttcctcttcccggtcgaatggtcgagtcagcttgattagtgccagtgctaatgcaagaaagcgctttgcttcaagtgaactacctgtctttgaatcatgcttcgaaactccaactagcgtactataatatggggaaatctaagattgacgtaaaatag

SEQ ID NO: 16894 - DNA, 866 bp, Citrus sinensis
  misc_feature (4)..(4): n is a, c, g, or t
  misc_feature (36)..(40): n is a, c, g, or t
  Predicted polypeptide sequence is orthologous to G1538, G1545
gggngaacacttctcgagctggagacacattaccannnnnatatatatatattcacacacacacacacacatatttgagagagatttatgatcagagaaatgatcataacaaacacgaatcatcaagttgaagataacaaaagtaatatggtcttgctttcccagttttacccttctgatgttctcacaccaactggaatcgttccacaacaaggggagccgtctaagccgaagcgcaggcaacgcaaacggaatactaacggaaacggtggctttcgtgctttgaagaagagaaagctgacggctgaacaagctgagcttcttgagatgtattttggcaacgaacacaagcttgaatctgacagaaaagacaagctcgctgctgtgctcggactcgatcctcgtcaagtggccgtgtggtttcagaaccggagggctcgtgataagactaagaagattgaggagacctacgctaccttgaagaccgctcatgaaaatgtcgtcgtggagaaaacccgactcgagtctgaggtggcaacgctgaaagagaagctttcagttgccgagaaggagattaagaaaatgtcagagctcattgaagggatttcactcaataatccgagtgccacgatcccaacggacatggacaccgtggactcaccgtttaccctggacccttttgctggtaatcttgggtggtttgattatgaggatctcctctacttgcttcaacagaattacatttctgctgccgagtggctcttactccacacctattaatccatcaagtgatcatcgacgtcgttgatttaggatgtgggcttgtagataaatgaccatctaatgtagctagctaggtttctagt

SEQ ID NO: 16895 - DNA, 780 bp, Citrus sinensis
  Predicted polypeptide sequence is orthologous to G1543
tcatcatcacccccttcaacaagccggaggttctgcgatgaaggatttggacataaaccaagtaccatcagaagatactgaatggaataattggaacacagcaacagcaacaacaacaggatcaggaagcatggacgatgaagaagagagctgcatcaacgttgacggcggccctcctcgcaaaaagcttcgcctctccaaagaacagtctcgtcttctcgaaaagcagaaagaagaactggctacgcagttgaagctgaagccacgtcaagttgaagtctggtttcagaatcgtagggccaggagcaagctgaagcaaacggagatggaatgcgagtacttgaagagatggtttggttcattgactgaacaaaacaggaggctgcaaagggaagtggaggagctcagggctatgaaggtgggcccacccaccgtgatctctccccacagttgtgagccactcccggcatcaaccctatcaatgtgtccacggtgtgagcgcgtgaccaccaccgccgttgacaagggccccaccaaggtcaccaccgcctcctccactcccgcggcattgtctcctaaagtcgggacgccggccctccagtcacggtagccttcggcggcctgatggaaagttaaacgtggcaaaacattaatcaaaagcaaaaggagaaattagttttagaggatgttcataggaaaagaaatatgcaagtgtgcatgcaagataccaatgaagataagatactatcattgatatatatgtgtggtatctgatctgct

SEQ ID NO: 16896 - DNA, 903 bp, Citrus sinensis
  Predicted polypeptide sequence is orthologous to G1635
taaaatagcagcatttacttgaacattaactcgccaagaaaatgaaacttgttttcagatattatacaaaaaggtagaacagaattggtgacaaaaaggaattcacagaccaaagaaggaaaaaaatcaaaaggaacgtaaaaagctataatttcaacagagagaaacggcaatttaaaattgaaacatacaaaccggacacctactaatttgaacagttgcagataaaaaactcggtgactagataacaatttgcacagctgtggaattaatacgcattacttcatttaccatcccctatctagcagcagaagaccgcttcagtcaaaacattatctgtgctacccaaatcagttcctcaagtccttgaacaagagaactatctactaataagatcatcagctctacaaatcatcggctttcctagaaatatgggcggcatctttaccattccctttgatctcttccattgcctactgctgacaattgattgtccctttccactatacgttttttatacggcacaaatcctttcatatgcttatctgttctagttcttatcacagagaaggcagaattctcacttggtttaagctcaaaggctacctccagccacttatcctccttatccaaagattgccgactactctgagagtcaacatcagaacttttgtcaatactgtcttcttcattaactgacttagagttcgaaccagtcaaagatccttccttcttgaattctctaccctgaacctccttaacactagaatgtaaacgtaaattttgcacctgctgattatttggagtgacagcatatggcaaaccatgagagaaattccaccatggaagatgagcaccagaaccagtatccaccatatttgagtcatcatctgtcgattgcat

SEQ ID NO: 16897 - DNA, 885 bp, Citrus sinensis
  Predicted polypeptide sequence is orthologous to G1635
ttgaaatcatctttttctttttcccttttttgacaaagaggaagtgtaatttctgtttgtttgagctacatagaattggtagattttgaggaaaaaaaaagaaaaaagaagaaaggagtatgagctttaatttatgtatggtgattttgattgcggagaagtcgaagacagcgggaactgctgttattgcggagagtgttgattcctgaggcaatatttaatcttgagaagagaaggagatcttgcttagttacaagaatatggctgttcaagacgaatgtggaggtaatcattcaaattcggttttctcggctggcaatggaattgaatcaagttctggcctgcatactgtaactggtcttgaagtaaaggatcagttttcttgtgggaacgattttgctcccaagccaagaaaaccatacacaatcacaaagcaaagagaaagatggacggaagaagagcataagaaattccttgaagctctaaagctgtttggtcgagcgtggcggaagatagaggaacatgtgggcacaaagactgcagtgcagatacgaagccatgctcagaaattcttttctaaggttgttcgcgagtcaaatggctgcagcacaagcccagtggaacccgtcgaaattcctcctcctcgaccaaaacgaaaacctatgcacccttaccctcgcaaattggcccatccacctgttaaagaaagcctaaatccagagctatctagaacatctttgtctccaattttatcagtttcagaacgagagaaccaatctccaacatcagtattgtttgcaataggctctgatgcctttggttcctccgattcaaactctccgaatggcagcttgtcacctgtttcatctgctgtccctgaacagc

SEQ ID NO: 16898 - DNA, 792 bp, Citrus sinensis
  misc_feature (48)..(52): n is a, c, g, or t
  Predicted polypeptide sequence is orthologous to G1638
ggggagctgaagagacatcaaaccaaagcttcgttatttttttttctnnnnncagcttttaccacttaaattatcaaaagccactctgcttcctctgttttttgcatttcttttcattgtttgttaaggaagtattgtacctcacttgaaagttttaaaatttattaaagggttgtgcttagtctggcgatatatgatctgggttttgtttattttcttgttttagttttggtttatattggtggtgatgattgttgatcgtctaggtttgtgttgtgattaaactgagatctgcttttactctgttgtttctggaattttccttgttttttggaaagttgaaaacttttttcagattcctcaatttgtgcttgtctgaaaaagtttttgctcatattccaatcaaatgccttcttgatttgatgcttcttttgtcatagaaaaaaacgtccactcctctgcatttgctatccgggttctctatatttcagagagagaggtcttttatctgctaaattttgtaagccatctttgttatgctagctagattttacttcacttgtaccgtctaaaacgatgagccgaggaattgaaatcctctcacctgcctcgtatcttgaaaactccaactggttgtttcaagaaagcaaggggactaaatggacccctcaagagaacaagcagtttgagaatgctttggctgtgtatgataaagatacccctgatcgatggattaaggtagcagcaatgattccagggaagacggttggtgatgtgatcaaacaatacaag

SEQ ID NO: 16899 - DNA, 1001 bp, Citrus sinensis
  Predicted polypeptide sequence is orthologous to G1638
ttttaaaagcacaagctttatattaataagcttctctaatggttcagagatccagaattccaataaatgatagaacaatctaactgatcagtgtagagtctgatactatggactcacttgactcctcatcaacatattcacatataaccaagatgctgaatggatgaagtaccctgacatcactgactaagatgcctcatataaataccttcagcattccccccattatgtacgttcactggtgttgcatggattgcatctgaaaataggcactgtaagctccaaactgagatccatttagatttcctccaagcagattttgttcctgcagcttaggtccatatgaagaaattccacaaaaaggagccatgaatgcagtcccattcattgagttgaaaagcatggctgttccctcgttttgtgatttccagttaaattgctcattactcatgtctaccatttttggttgctgctgcagctggatgactgcagcggaaggactgggagatggaggtttattattttctgatgaagaagttgcagtttcatccaggttaacagttgtaatatcatggatgctagatctcctcttatcctttcccccagtaagctgcctattgaagtacttctgagcatgacttgccacctgagttggggttctagtggtcacgaagttgcgggagatatttctccagtcccctttaccaaactttttaagacccattagaaattgcctgtgttcttcttcagtccaaggaactcctttctttctctcttgatcagaaggccgagtcgatgagcctctcttaccaccaggaccataaaaattcttcaaaccatcatatccttgattgctatcaacccactccaatgtgaaagaatcattaccataaccaggaattggaattagcccggcttcaatatcactaacatcctcttccaattccttgtattgtttgatcacatcaccaaccgtcttccctggaatcattgctgctacc

SEQ ID NO: 16900 - DNA, 497 bp, Citrus sinensis
  Predicted polypeptide sequence is orthologous to G1640
tttttttttttttttttaaaaaaatccaagcataaaacttattcaactcatcaagcaccattagtattacaaacttaaacctttgggcatctcaactaagcaaattgattacaatattttgaagctctaccacaaacttaataactaaaaaaaaaaacacttattgacacccttcaccattaccactatcccaaaaccaaaacaaaaacttgtcatctccatcccgtaattcacactgattataacactcaccaccacctggtgcccagtcaaaatcaagccattcctcatcaaagcctgaaaaattcatcattgttggatcaaatgtgtacaaaagttcatcctcattaaaaccccaaaaaacgctttccttttcagcactttttgccattttgtcttggtcccttttcacttcgtcttctgcacttgctttttccctgttaaggttactgttaactcgctttatttcactatccagccactcgtacggtcccaaa

SEQ ID NO: 16901 - DNA, 840 bp, Citrus sinensis
  Predicted polypeptide sequence is orthologous to G1655
tttttttttacaataaaatacacgaatataaaaatctcataaaaataaaaacaaagtagaaaataaagaattaaaagagaaaaaaaaaaacaaaaaactaataacacctggcaggacaaagccacggccttctacgatctaacaacgttcaagccaagccgatcatcagccggcgaagagccggctagaatagcggtgagagcagtcatggcccggacctgcatctccaaggcggagatgtaatcagtcgcttcttctagaagattcaacgacgaaaccttccggcaaccgggaatcatccggccgagcacgcgcaatttcttttggacaggcggcaacttgttcttcctcctcatcgcttcctccggcttcctcctcaaccggctacagccggtgactctcactttaacctgccgcttcttgagcctcaaactggggggactcgagagaatcgcgcggctccaccgggtggcgcctttggccgagacggccatcagcctatcagcggtttctcggattgccttgccggttctggccgacgagctccgacggcgcacgtggcggaccgcttggaaaagtttggacgagtagatctgttgctccttatccgttctccaacgcttcgtaacctcccgatacgctgcgtttcgggaatcatcatcatcatcatcatcattgcgttggcgacgacgaatcaactcatcttctcctcctactccgtcgtcgttgttccctattcttcgcttcttccgcttcggctccatatcgagcgacgtgtcgcaatttgattcgtcgaaagagtccataatcaaattctgttatggttttttttttattgat

SEQ ID NO: 16902 - DNA, 769 bp, Citrus sinensis
  Predicted polypeptide sequence is orthologous to G1706
tttttttttttttttttatctaaaagccaagcataaaatactgagagcctgagactacaaatatgtacatattgtctacaactctattaaacaattttacgaactcatgtaataattacatcttatggaactccaactagaagctggttcttgcagggagctctactcttgataggggaaaagctctacccttgattggggagcaaaattttttctttaaaatggcattatatgattggggcaatcccctatgaggctatgaccccactgtccagtccaccgccttgagtgagtgttcccaattatggctctccatcataatcatttgcccagcaaaaaggcttcatgaactctcggtatcattggctcttggcaagcccaaggtaccagaagaggaacccatatgggtttcggaagaacttgggaacttgctcttcttagaccattgccatatcttggaaacagaaaagctttcacctttacttctaaagttaattttcttcccctcaacatcaccgtcatttgaggaattgtcattttgtgcacttcttcccttaccaaacctcacactagcactaccacctcttctggggcataaggccacttgcagctctgaatcagcaaccacatactggtaggatcccattgagtaacatctcctagcttccaaattactacagctggtctctccttccactctttcaattccctcacttccatcatttgagcttctaaacttgccaagtctaacagaaaacactctcttttc

SEQ ID NO: 16903 - DNA, 858 bp, Citrus sinensis
  Predicted polypeptide sequence is orthologous to G1718
tttttttttttttttttcgaaaaaatttaccaatatcaaataacattttaataacgcattttcactgtacatataattccacaaactgaccaaaaaaatcacaaaaactcccttaattctcaattttcctgatcaggcctagagcttggagaagaagaaccagacacatcagtagaatctcttgaaggagaagtactttcgttttgatttgaattctcaccacttcttctaccaccaccactgattgaaaaactaacccaaatttctctccttcgctcatctcttttgttgccactttcctcttcttcaacaggcatcttgtatctacaaacaggacacgacccctgaatcccaagccacttctctatacagtttgcatgaaacttgtgcttacatggcatctctctcgccacctccccaacctcatactcctctaaacacacgacacactcaccaccaagagcttcctcttcgctttcaccgactttgatacttggcatggcctcaaccgatgcctttgaagcaggaggctggccatctttaccaacgaaatttctcagcagagtctctaaacttgaagtcccttcaatcactaccatgccctgattgagaggattgacgagaatgattctttcgcttgaacttctgtttgtatgaggggtttccccatccgggttctgagaattctcggaactttcacctgtggagacgctgcttgtgaagcctaagacaaagggtagaaacaaagacatgtctctgtgacttaacagtctctcaaacagcgatgagacatcagtagcttcagcttcagaggacatcgaaagaatgaaattttgacagaaagatcaaatctttttt

SEQ ID NO: 16904 - DNA, 866 bp, Citrus sinensis
  Predicted polypeptide sequence is orthologous to G1777
ttttttttttttaaagtataactattttacccaaaaaaagggcaattcactgtaaaatgattccgttctcctttgtccccaaataggtttgtgtgtgtagagcttttttattatctaagtgtcaacaataaggaatttttgaagctttctctacagctgctgagttgaaaggagctattttatgaaccgaatgcttgagagaacccagtagatccgcttcaatccattcgtacaaattccggcagagataatcagcggtgactgattgagtaatgaccctcattctgaaatccttaagttggtgctcggaatatttctcaaaattttcttctaaaatcaatgaaagcctctcaatgttggtctcaaactgctgctgttggtcctcaaaaaagttttgctttattttcctttcctctcttgtcatctcatttttcaacaggtcatcggcaaacatgtaaaatgcaaatgggtacgaaaatgaaaggatccgccttgctctaaagagcttattcagtccatcctttatccagccaaagtccttggatgatgtgtccttttcacccagtatttttattttatcctgtatgtcttccttcatctcatactcaagcctaaaagattctgtatgagctttgtacagtttgtggcagtgataatagctttcgagcctccacttcccatgctcaggtctcttttccgaaacttctatatatccgtttgaatattccaaaccggaaatccaattgaatgtgatcccacacttgcagcgcaccatgttgcaacccccattcttttcaattggcttgcaacattttgggcaaggttttgtgtgggaagagatccaattaagcgaaagggattctacc

SEQ ID NO: 16905 - DNA, 411 bp, Citrus sinensis
  Predicted polypeptide sequence is orthologous to G1781
ttacttctgaggtctattacaattcatcatcagaaactagcagcgaccttttcatttgaagaatatgcaaacctccatgtgtaatgagtggttggagggtatccttcctccaatccttataagcttggttgatgatgagaaagtgaataatgacaaccttgatttttttgttgttcctcagtatgggagaaagcctgattatactggttaagtgtatgtaatgttactcttttgtgttatttttaattaaataaaaggatgggtactgttattacctgtcaatcatgtaagtgtcaatttggttttattaaactattaagatctcttgaggtaagcaagagatttcttttttaaaaaattttgagtccatgtaatttgtcatctttaataaataaaattaacatgtgttaa

SEQ ID NO: 16906 - DNA, 814 bp, Citrus sinensis
  misc_feature (757)..(757): n is a, c, g, or t
  Predicted polypeptide sequence is orthologous to G1804
ctcacagccacctgataacaacaacaacaacaacaaccaagacaacgaaccaataatgggcaacaaattagtcgtcgaaacggtcgaaccggccgccacattgacccgacagaactcattttccatccctatccttctctgcaaaaaccgtggaggaagtatggtccgaaatccaaaaggaccaacaaccccaacgccgctgccatgtcgagccacctcagcgccagcctaccttcggagagatcactttggaggagtttctcgtcaaagccggggttgtccaggaaccggccaccaagccttgtcctcagtcacattcgccgccaattcatcgaagtaacaatgacagcaacaacaacaacaacacgtgtttgggttcagcatacggcatggggctgggacctagtgcgtgcactatgatggcgttgggattttctgctactcagccgagcatggggagcaacttgttggtcaatggttatgcagcttacccaatatacactgcaccaaccgaacttgtgggacagctagctagtactgatagcaacaatggtgatgataaagagaagagccagggcatgatgttagaggctgttggtccgaagggcaataggaagaggatcatagatggtcctcatgaggtggtcgtcgagcgaaggcagcgtagaatgatcaagaatcgggaatctgctgcgcgatcccgtgctaggaaacaggcatacacagtggagctggagctggagttaactcagctcanagcggagaatgataagctgaaagaagctgtgaaggagcttgaaacgaagcgagtaca

SEQ ID NO: 16907 - DNA, 919 bp, Citrus sinensis
  Predicted polypeptide sequence is orthologous to G1804
tgggtgcgggattcagccccatcacatttcccaattaacatgcatgcacaggtggtgacgtcaacccacaacaaaattgtgccgtttatcccgcaaattgctttttctttcccccaaatctttcatcatttaggtgttgttgctttgcttccacagcatttgcagtgcaaaaatggtggcaccagagccggaaacgctgtcccaaggcgaggtggaatcagcattgcgggcagaccagcaccagaagacattgacgttactcggacgacaatcatccatttactcactaaccctggatgagttccagcacacgctgtgcgagagcggcaagaacttcgggtcaatgaacatggatgagttccttaccagcatctggaacgccgaagaaaaccaagccatcaactcatctacccaagacagtaatatcaacgccaacaacgttattaacaatgctatgagcaataaccatacggtacagcatcttcctgtcaatgaaacaacagcggcaacgacagcccacggaagtatagtcaagcaaccgagcttgtcaaggcaagcctcgcttacgcttccggcgccgctgtgtagaaagacggtggaagaagtttggtctgagatacacagaggacagcaaggtgggcaccagcagaatagtagagtgactgagaataatagcaataacaataataatgtgcggaatcctgaagctgcatcgcggcaaccaacttttggggagatgacactggaggatttcttgattaaagctggtgtagtgagggaacagaacaccacgccagtggcgcagcctccgccgcagcagcaatttgggatatatcagactaataataaccccgtgatgagtcctaattttggcaccgggcatgtcctgggactgactggtgttagtaatggtgctagc

SEQ ID NO: 16908 - DNA, 712 bp, Citrus sinensis
  Predicted polypeptide sequence is orthologous to G1835
ttttttttttgaatgtaaagcggcaaacagctttataaaaaaaaaaaggttctcaaattgcattactcatatcatatctcagaattaattttctactaacaaatgaactgcaaaaagaattcccatgaacaggagaaaaggaaaaaaagaaaaagaaaaagaatgcaaaaaagaaatttgaaacacagaccggcaaatatacctaaatgactttagggacctactcatcactaaaccctaaaactctactacccttatgctttcctcctctttctctaatccttcttcagtcctctcattacagtccttcactacttagctaaaatttggtcacctattgctcctattcccccattccatccctgtacaagaaacaaatgaacaaagaaatgaaataacaataagcaaataacaaagaccggaaaagagatattcccgtcagggaatgctgctctctgagccgtcttgatccctcaaacgtactccagcgcaaggtggttattgtttggaatcaactctggtgcatctgtcatcatcgtttcagtgccagccacaattggcttctggcaattcttgtttctcatttcaacaacctttttgtgggaattggagtgcaaggatgggacaaatgtcgggctagcagcaggcctgtattcggggaagagcctgccagacttatagcgaacaccgcatgcattgcaaagggtttttg

SEQ ID NO: 16909 - DNA, 321 bp, Citrus sinensis
  Predicted polypeptide sequence is orthologous to G1837
ggggatttaatttcttcgtaactccattttttttctttattttccttcattttctcaccatccaaacaccatcacatagcttcaattctccaaaaagcccatgtgggttatctcattggagctccggaaactcccaactgacattcatcggatctctttttattctaccaactttctctgattttccctagctttcgcgccatccaaacaccggtaaatgtcaaaatttggccccggaagcctcatataattgcaacagttcacgcgggtgtttagtttttcgtcccaaaaaaaaaaaaaaaaaaaaaaaaaaaaaaaaaa

SEQ ID NO: 16910 - DNA, 943 bp, Citrus sinensis
  Predicted polypeptide sequence is orthologous to G1855
ttttttttttttttttgtaaatattctctcttgaattgctatactcgtcctaatattttggtaaataattttatgtgatacacagtaagatataaatacatcaatacaagttgggaacgagtattttctttagctcagaaacttaaaagtcaataaattaactacaatgaattgtgaaccaacaatatcttctcaggatggaaacgccctccgtcaccgtgtaacaactgacaattcaatctcattcgatctatgatgccttttactttcacaataatgtcgacgtgatctcttattatgatcgccccttctgggcgaagaatgcgatgcatctcgagaaggatatagacaatgtcacacttgtccatgtacatgccgaatacaccgtcggcatgaatcaaatcgtatgttctggggtatgtcgagaaggcctcacaccaatctatgtaggtcccaatgagcccgcgctcatacaaaatgctgagggtattatgttttgcatcaaatggaactgcattcatgacccaaactggatacttagccagtgcggctgcaaagccccctaagccagcattcatgtccattatatttctgaatttaccagagaagagagattcgagaatgattctgtaatgggaaactctctttttccacagctgattgtcttcgttaaaggacttaactgtaatgccttcaataaacccacttctgattcgaggtggagcagtattcaatctctttggccatttttcaagagcaccgccggctacatctttgatttcattcaccattggaagaggagtaatgcatggttccatcttcgtgtacagcaattggtcccctctctgctatctttttccagcataatcgtgtagcaagatttttcaagctgatctgctccttctgcagatccttagcatctctctcccaacctctgtaactg

SEQ ID NO: 16911 - DNA, 830 bp, Citrus sinensis
  Predicted polypeptide sequence is orthologous to G1863, G2334
ctttttttttaaggcaatcaaacaacacaagcacactcaatttatacaagagtcaccagaagagtgtcacagtttcgttataccacgaatctaagaatcttttttttttcaaaaaaaaaaaaaagaggaccaaatgaaaaccaaattatttagttacaaaatcaccaacaaaaatcaggtgctaacatagctagcctctgaggcagaactgcggggtaattgatgtagaacgcttgttggagatgaattagaattggaagtcgaagatcgcagagcctctgctagaggtcctcccatcgaagccaccgtgtgagtggcccatcctgccgcccaattcagctgcggctcctccctttcaccgccctgggagccgggttcgtctatattgccagtggaaagtttcaaagacacgtcagatgacgacaaattgcccggcatcgaaatggagaggcaggtggcagaattgactgtgctagaattgctctcacaattgttgtgatcgtggagtgaccgtggccagtcatcaaaaaaaggcctcaaaatgtgaccatcagacctattaccaacctcattttggggttcaaacaggcccttaacagctttggacacacaggaactttgattgaactgaagaagatcaatggaaggcgaatgcgcggaaagagcaaaagtagtggcgttagccatttgagcaaagggtgaaggagcagcaacagttgcagcagaaatattattattattattattattaacggtgctgctagtggttttgagagtagtcctagcagcagcagaggaggtgggtgtggggatttccacatgctttcttg

SEQ ID NO: 16912 - DNA, 800 bp, Citrus sinensis
  Predicted polypeptide sequence is orthologous to G1868
cacagcttcctgagttaaaagtgcccaatgcctacaatttggtttagccattaagttcatactataaattcttaaaaccacaagcctagaaggaaccagataaaattaaaaaaataaaaataattagataaaaggagttgctgcaaagcctcctactcatcaacttgctttaaactccagcacttgacttgccccgctttgcttttgtcttcaccgcccaggttcaactgctgattacagagatggtatagaggaggaacttgcaagggctgagccaaccacatcgtcgcataggtttgctccatcatgtgccttcttgttctcagctataggactgctccctgaactgctatttgaaagtgaacagaaagttgacttctgcaagacacctgtaggagaagatcccaattgtggactgccatcccacccttctgttaaaaggtttagagccgagttcttgcaggcattcacatttttactggtgttggctaaggcctctcctaaaggacctcccatagaactaccccaagatatcggtatccagttagtctgcttttggtttggctcaccgaggccaccattcatccccaaaccagcatgcatagggtcaagctcccgagataattttagtggtgatagtgcaagcctctcatgggtgggagaggatgaggctgatgagaactccggaggggccatggggattgacattgatagctgagtccagtctgatttaagctcctccggccaagtaatgacagaacgattagactcatccttgggccagtcatcaatgaattgcc

SEQ ID NO: 16913 - DNA, 822 bp, Citrus sinensis
  Predicted polypeptide sequence is orthologous to G1868
tttttttagtcaaaaactaaccttattattaataacaatcacttcctgttccaaaaccaaaccctattactgcagagccccaagcaaggatgcagaaagttacaaagagggttcaagttttttattacctccatcataaagaacactccttggtgagaaaccaaaattcggcgagggattactggcagtagcaatggcggtgctgctgttattgacagcagggagtgaaatggagaggttggtattagcatttgtaattgcagagcttgtactgggacttcgtctagaagcttccacaagctttcttgaacgcaggcgccctctgtgtacatgcctctcacagtacttgtgatctggaattgcttctttgctacatcgccattttttcccatctgttcttctgcatctgcctggctctgggtccatgccattctttaactccaagtgcaatgatccagacccataaaagctggggtagagttgatgaagatcgccactgagacctgaaacagagctggctacactcttccaaatgggaatcacaagttgagagggcacaggaagcctagcttccatgtatttgaagattagagattgaagctgtagctcttgtagttggaaaattgtgaaaccataggaccttttgctgcagccagttccaagctcaagctcaagcgcaattgaaggtgatccgtctcctttactactttccatactgcaagaacggctccaatttgcccgtccggtcccgaagtctgctaaacgggcgagcttggttggtgggttttggggcttcatttactttcacagaaaacggtcaaa

SEQ ID NO: 16914 - DNA, 797 bp, Citrus sinensis
  Predicted polypeptide sequence is orthologous to G1927, G2184
cagcccttgtttcttcagaatttggagcctgtcgatcaggaagagaatacaaatgctctggcaaataacttggtgaaccaagtagatcaccagttccagcctcagtcagtggtaaaccaggtggataaccagttgcaaccaaatttgattgtcaaccaaatgaatcaccagttggaaccaaattcaatgggaaaccagacaagtcaccagttgcaaccaaatttggcggtaagccaggtggattacgagctgcagccccattctcttggtgcagaagatattagcagtcagcaatggatgcatgatctctgtgcagaagatattagcagtcagccttggatgcatgatcagctaactaatttcttcactccgacagaatcgactcaagggattttgtgtcccccaatctcaggttccatacaacaatctgccaatcaccctactgaagcaaacccaaatcaggatcaaagtggccaagaagttggtggtgcaacaagtcggtttgcatcttctttgtgggcctttgttgagtctataccaactactcctgcgtctgcttcggagagcccattagtgaatcgggcgttcgagcgaatgtctagctttagtaggatgagaataactgcaagaaaccccaatgtagctggaggtgatgctgcagctttaacaagaagacaggcgagtagtaacaggggatttttacttttatctattttgcgagcattgtgtgccatttttatggatgttaatgggaactatgagagtcttgagcagttgcatctcctcttgattttatg

SEQ ID NO: 16915 - DNA, 939 bp, Citrus sinensis
  Predicted polypeptide sequence is orthologous to G1928
cctttttttaactatagcatattttggttccattatacttgctgattaatttttttaatcgaagatgaacagttgatgatgaattacaaccaaattaactatatgtaaagcaaaatgacagaaactgaacaattatacgaatttaacccaaggaaacacggtggaaactggaaagcaccattaagtatccgaacatatttaaaatgccacagcaggatttttcttttctctctctgtagctctctttatagggaaatttaattaatcagctaacccataagctaaccttgccaagttcttgggttctgattctgcggtccaaacgttgaagaagaagaaggattaatttgatcaaggcctgctatattgacaaaatctctatgactatgaggaaatgtttttagtcccaaaaaatctcttgtcaaaccatcactccctccagcgttgctaccgccagcaccgccaccattattgtctctagtttcatgattatttctgctaagttgggcatggtgaaaatcgccgtatccttttggattcagtatcccattcaatgcatcatcaaaagatgacgatgacccatcaaacccatttgtacaagaaaaagaactcatcatcatatcatgcagaagagatggagctgtcccagggcctgttgtagtagttgtagtacttgcagcaaactgttccatgtaagcagggttagcagcagcagcagctttattcccaaaagatgacaagttattatgaacaaacccacttgccaagtcttcacgtgatgacaaacccagaccagaagaagaaccagcagctccagctgtagatgcggaaccagcaggcatgtgatgagtttggtggggtactggtactctaagcacgggtgcaggtaatgcagatggctgtgtgctcatagtcgcccccatttgtgctgctttttgc

SEQ ID NO: 16916 - DNA, 604 bp, Citrus sinensis
  Predicted polypeptide sequence is orthologous to G1954
ggggaattggaaattggcagatggagtcaaaaacccgtgttaattgttatcgcgaaactacctcaagccaagaatcccaaactctgtctttatttttcattttgtattcctcgctcgcaatcgctttacttatcttgcttgttcctcatcaatacgccgatggaaattttgttccgggttccatatttgctgcgcagccatttttgtttcacgcctttctgttctcggtcctgctctcattcgccggcgcatctagctctttgttgattggaatcaattgcccgcgtacggcaattggtagatgttattacagaatttcaatggtttccatggcatcagctttattgatactggctttagccttgtttcttgaaattttgaagcttctgggttctccagatcttgagtggtggcagcttctatttcaggtatttggaaggatcagtccttctgaagaagaagaaaacagagagttatagagtccgctgttgggttttgatttctactcatataataattgttttttaaaaaattggcagtcttattttctttttcaattaagaagatataatgtaaaaaaaaaaaaaaaaaaaaaaaaaaaaaa

SEQ ID NO: 16917 - DNA, 663 bp, Citrus sinensis
  Predicted polypeptide sequence is orthologous to G2035
tttttttttttttttttcgtggaacttcctctttacataacattgaagctcaaaggcgcatacataatacgctttataatagtggttaatcccggtgaacaacagttacacagagcaaacaccaacaacataaaacttgtgcagctgaaccagctttttctagcatctggccatagggtagtgtgtttacagagcatatattttctccatgtcaaagttatactcatcaacgtctgacatatttgcggagtatactgaccatgagaatgacttacttccacttgcccttctaatgcgtctctgagaatcgttgcggaaaagcccaaaacgttgtcggaaaacaaaataacacatacttgcaagtgtcccaacaagaatcggcgctcccattagggttatggtgatagccatccatgaatgtccgtttcccacaaccataaaagctatagacagaaatgctgcacaagtgcaagcgcatactgtccacattaacttgttcactactgatacaacctgcttctgagcagtagtatcccaggctaccaaagtgatctgaaccactacaacagctagagatatgaaaagagacgttgcatttaaaaggcagaacacgcggaaacctactttgtcagcaatgttagcctttcctacttctggtccatg

SEQ ID NO: 16918 - DNA, 666 bp, Citrus sinensis
  misc_feature (656)..(656): n is a, c, g, or t
  Predicted polypeptide sequence is orthologous to G2071
ggggaagaaaaagcggtgctctggagaaagtagttgagaggaggcatagaagaatgataaaaaacagagagtcagctgcaagatcacgggcacgcaagcaggcctatacattggaactggaagcagaggttgctaaactaaaggagttgaaccaagagttggagaggaaacagttttgttgttgcaggcagagaaaatagaaatggaaaagaataagattatcgagaaaatgaagtaccgatggggaggcaaaatactgtgcttgaggaggacactgacaggcccttggtagagtaaaccagttgagctgctgataatagaaagtttgtttgaaaacgcaatcttggctgttgatatggtacgagaattggtgtgcacatctttgatctatttctcataccatggagtgtaggcagctgcatgtatagaaaccaagtgttgtaaattattaaccgaaattagttttatactgtggaccaaacgtctaatctgtaagacttctgtttgcttctggtttgaacagagaagtattgtaggatagataagcagactgtacgctttaagtgtgtttttaccggctacttgcagacttggttagtctctaaccttctctttggagttgaactttcaataatatatgatctatttgcattttngaaaaaaaaa

SEQ ID NO: 16919 - DNA, 782 bp, Citrus sinensis
  Predicted polypeptide sequence is orthologous to G2085
ctttttaaaaaacttaccaacatatctactaattgaagcttcatgtgatacatttgaagttcctttttgaggtgatctcaagcacaagtaacaatgattagagtgagacaacctcatatattgaagggactataatatctgtacatataagacaagctaaaggaaattactagaaaaccttatacttgaatgatggtagccggaccactctaaccatataggaagaaaggacttagtgctcggatattaaagctgaatcatcatcattcgagaaagaaactagttcgttgtctgtatgagcggcagttccacagtccgagtcattcacttcaccttcaccctgctcagctggagtaagaggttggtcctccattttctttccgagatcccttaaagcacccttgtttgcccaaaaaagaccacaggcattacagagggatcttggcccagaaggaccacgtcgcatcattggcgtagacttcgaactaatgccacaatgtgtacacgaggtttctgatgggctgtcgtcttgtcctggatcctgggcattactccaaccaagagctcccccttcacacttcttggctgaagtaaattgacctttgttccgctgcatcctgagagcaacctcttgccggacactgtatctaactttcttatcaaagcaacgctctttcctcttctgccgaaacctatctaatgaagctgctctttgtggttgggtacatttagcaggatagtccgcaatacccctctggctgtgaggaattacttccatgccc

SEQ ID NO: 16920 - DNA, 740 bp, Citrus sinensis
  Predicted polypeptide sequence is orthologous to G2094
tttttttttttttttttgttgaaaaaactcatcatcataatatcatttgggcaaaggggacatccataaaatcctagtattattcttattatgattattactgatttgattttttttttttcgggtaatcaactaagcataaacagaaccataagataaagccattaacaaaacagcagcttgctcttcttctccaagcttctttctttgcttcaccacaattgatcgttgcatcaaaacttctcttcccaatgcgtacaatctttgctttaatgaatccccaagcttattacttgagctattactgctgctattgctgttgcctctctttgattttttcgcctctttaaggattcccaatattgccctcctcttcttcctgctccttatcccggatgcattacacagtgacttggggccagcggggccaccgcgccacagtggggtcttggtgggcccacaatcagcacagggctttttgatactattttcatccgaagaaaccccatcaagcctcttgctgccgctgctgttcacttctgcggattccaatcctttgacactcggatccatcatgttaagaagatttgtcaagaaactaagactgacccaggggaaaaaaaattgaaaactgaagtgggttttgatcaaaacggaaggtaaccactctagctaatgatttggaatgaagctattagctggccggggctaaaaatgaatgaaggaaagaatgaatgaat

SEQ ID NO: 16921 - DNA, 335 bp, Citrus sinensis
  Predicted polypeptide sequence is orthologous to G2109
tgtatggaataatagtccccacaaaactttccaccatagaataataatagtaatgcatttctagcttgcactaacaaagtgtgggttggctgcttgggcatgtcttttaagcattttgttctattaaatttatcataaatcatcatcatcatcaccatcatcattatcttatggtgccactgccaacagcacctgtaaaggcaattacagttgagtttgacctttgtatttgctggataccaaatggttgagccttcaacacgcccatgttcttatcctcctatatgtacgtgcaaatgatgctcaaaaaaaaaaaaaaaaaaaaaaaaaaaaaa

SEQ ID NO: 16922 - DNA, 724 bp, Citrus sinensis
  Predicted polypeptide sequence is orthologous to G2109
tttttttttttttttaagaaaagccatcccagttttacagggacctctaaaggagatcgtatttatatatatacagatggtatatcaacttgtatgatttatatcctattaaaagctaacatatatattacacaaaattacctgatggccttcgcccatctctttgaattctctttatatatcagaaacctcatctaaaaatttgacaagcaacaccagaacaaaatgtatgtccacagaagtattttaccataatgcacgttcacttctgtgctaccagtcttcgcatccgatcaaagccatgttgactcaggaaagtctatttgtttgctggtggtaggaattctcatcaaacatggcaatgccacaagggccagaagcagaaacccaatcatgatgcccattgccgtacatgggtccagaaagttcaaagttgctattgacttgataaactgcaggatttccttgcaagttcatctcagcatcaggcttcaacttcttatcatctgaaggcaaattcaagctactatatggagggtatgaatattgctctccaagttgtagacttatgcatgcattgttactcaactcattcaagttgccacctccatgttccatattttcaacctgccctgaattaccaacctctatctctttaccagcgcccaagaaaccagaatagcttgaaatgtgggcatcttctgaacatcccatatctctttga

SEQ ID NO: 16923 - DNA, 815 bp, Citrus sinensis
  Predicted polypeptide sequence is orthologous to G2114
tttttttttttttaatctgaagtagttatattattaattaataacagtaatcgtcatcactttggcaaaatgccataaaagcccatagcagtacaaacaagagaaacaaaaaagcttctgcttgcccccacttttaacacgtaaagtctaaaatagtcaaaattaattagttgatcaaaagccaaaaccatttaacccggcgttttgtgttaacttatactaccatctatggcctttactttaacttccatattgagaactccaactaattcccttctaccagcttatggttccaaatgcaaaggccttttacaagctcattcattccacagagcaaacataggaacatgatgaaccaaacccaaattcacaagcctattgttagttgaatgattccctccgttatcatcatcacaattttcgtacttggtacccggcgatgagaaatagccttcattatactctgccccgctcattccaaactcactggtcaaacccaccgggcactttggactctctggatttgatgagttcctactgccagaagcacccaatgaggtctcattgttggtgttagtattttgatgttgatgatcatcggagttggcactccacaccatgtcaaccaattcatcagatgcttcaccatttgatatggcaaggggttgaggagatgtggatgaagcacaagaattatagtcctcgagaacaagcggagcagagtctttcggtgagcgttttgcaaggtcactggcaatcagtgtggagcttgagcaaattctctttacatcatacctacttatatcaaaatcctc

SEQ ID NO: 16924 - DNA, 701 bp, Citrus sinensis
  Predicted polypeptide sequence is orthologous to G2116
tttttttttttttttttccaaaaatggaaaattttaatttatttcctgttaataaaagtttaaacaataacaaacaaacaatacaatgggggcccctaacaaaaaaatatgcacttttctaccccttgaaaaataaccttctattccctgatgaatgcccctttgtctgtcaataagggcagtctatgaacaattcaacaaacatgttgggaccaaaaatcggcagcatttgcatcaaaatgggctgctgctttcactaacaaaaattgaggggccttcaaacttcactaaaagaaaatttctgccattgatatcaagcccctgcaatcttccaaaaggatcctgctgcaacatctctgaaaaggtatgtgagttggctgtaactaacataggctgatggggaattgacattttaggctgaaaaggatggaattctggcaattgtatgatctgggggtccccaggcccagtttgaggggggggcggaaaaaacaatgattggttatatggaattggttgcattcctaaattaaagggggccgggggtgtcatcatttcaccggttgcaaccttgaccctctccacttccttttttaaagcttcattcaaagcatcacgtaattgagcttgttgttccataccctgtaaacaaagtttaagctctgtattttcagaaaacaaatctgttgtgtccctctgga

SEQ ID NO: 16925 - DNA, 498 bp, Citrus sinensis
  Predicted polypeptide sequence is orthologous to G2130
ccaccccaaaccgatcaaacatttgattttgtaacgagcggctatgattccgaaaaagagtctcagtctcagactccaacgtccgcaataccttccccgacgtccgttctcaggttccactccaacgaggaaattgagctcgcaaaaacagagttgtttaatcttgagagtgatcgctgttgtccgtctcaggatagtttccagatttatgattcggagctgttggattctgcaactccggctccaatctttttcgatgataagatgtgtgtgccgcttttgaaagaaaatttgggtgacgtttctgtcgatttaggcggggatttcgattcatgcatttcggagtgggacgtcgataattactttcaagatcctcctcctttgcccgattcgcattgacggtcttactgttagttatcagttttgctctctccctcttgtccatccacaagtgtgatatacatatattttgccctctatgctctttatttattagcc

SEQ ID NO: 16926 - DNA, 813 bp, Citrus sinensis
  Predicted polypeptide sequence is orthologous to G2142
tttttttttttttttttagtaagaaaacctgtataatgattcactaaaatagagtaaataaataatacatatttgctaggaattctatgcatcctaacaaactgcaactctctacatgtacaatcgatctaggtctcaactgggcagttttataaaccaggagaagacattataaataacaataataaactcccccgattttgaaaagggtacccccaaaaaatgaattaattaaattacaaaaaagaatagtgtggaaattttgatgttaacatttatctatcttttgcttctttagtgcttgatttgagccctcacctccatttctgtctctagaaccagtggttccttgattgctagccggaacttcatttcccttaagattcgatgctagtgtaattggtgcctgagcagctcgtttcccaaggtcaatttgcactgagacgctggcctgtgacaaatcaactccagaactctgcagtgcttgtgtcagagtctttagcaatccttgagaatacgcagttgagatgtttattctgccaccttcaacaggcagctcctgttcttttaacttcttattattagaaataggcatgtctcccgtacatgacctagtgtgacattccagggtttgaggctgagaagtcgtgttctctgcatcggatgccagtctaggccgaagtgaagctgccgcaccaccattcctaacaggtttgtagcagtttggctggagtgacataggaaagggcattgccttatttgttattccaggctggggatccattgtcttgaatgtagaagcagaggtcatgt

SEQ ID NO: 16927 - DNA, 445 bp, Citrus sinensis
  Predicted polypeptide sequence is orthologous to G2143
tttttttttttttaataaaattattaaaaatataatatatattttattatacaaataaaaaattatatcaaaataacttacaagatacaacagttaacatttaccaaatattttaattcaatctcaatcccaaacgcaccctatctttatgtttacaacggacccctcacatattcacttatcgacgacgtcccaacgcaagggcacaaatttctattttacttgttggttcacacttcatacctgaaatttaaccaaagaaattacaagagtgaaagcagaaatgggaaaatggcattcatatacaatcgaatgcgatccaattgacttaaaagcacctataaaaataattattaggtaaatcattacatgttacacaactgactgaaaactatacattgtaaacttttattataaaaataattttttttgggggggggggggg

SEQ ID NO: 16928 - DNA, 217 bp, Citrus sinensis
  Predicted polypeptide sequence is orthologous to G2143
ggtctggtggaagtatagatggtttaaatgacgctatacattatgttgaatatatcaagattattgctgaccatcccgtagtcaatacttttatctctggtggaggcactgtgcagtacggtatgggacgttaaactcgctaagctgggatgtcttttcactgcctgttttgtatgtatcataaaaaatgtttcatttcaaaaaaaaaaaaaaaaaa

SEQ ID NO: 16929 - DNA, 988 bp, Citrus sinensis
  Predicted polypeptide sequence is orthologous to G2144
aatgtccaatagggctacacagttactttacaagacgataaagccacagatcatattatagagaagaaaggaagacttgcataaataagaacgcacgatagtccactctatgcttttacagtatgaatcaatcaatcatctcagaaattaagaattagattgaatgactctgaggggaaaattagtattctaattaagtaagagatacttataataaatatatttatatttatataagaatgacacactgaaagtgatcgtctccggtagaaacaaatctgggtttccaaatgactcggggtaaattgaagacaaatggtagcccaggatcaatgctgaggactgccctctactactctgctaaccgctaatattatcatcaatatatacagtacgaggtactagctactgctggagagattcattgcatcttcatagctccatcttcaattgatttgtgtgcagagttgctgaatttgctgaagaatcataactcaaaagtgagttctcgggagtaacaaagttatggctttcttctgctcctcccaaaagaggctggtgatgcccatcaaaatgatgccattgctgttgatactgttgtcggtttccatgggcttggagttcaggccacattacaggcataaccacgccagggaagctactgtcgattaacgatccactctctgcaacaaataagctgtccagattgaaatcaatccttggattgactgctgcaagtctcattgacaagaactccacttgacgctgtaacgactgcacatggttgatgatctcatctaaaactaatgctgtcccagaaatcttattgcagcccgggaccagctcttgtaacagcttcattcgtgcattaatcttctctctcctcgctctctcggccaagctgtggctatctgtagcttgaccgcgacgagctcggacgtgaacgtaaggaagtttctccgcatcttcgctgctatcgttagcgcca

SEQ ID NO: 16930 - DNA, 948 bp, Citrus sinensis
  misc_feature (928)..(934): n is a, c, g, or t
  Predicted polypeptide sequence is orthologous to G2226
gggggcaagcaagccattatcaattcaaaacgttaaacaactacttgcacatgagatagtgttcttagtcttttagatagactaagaaatttcagctcgtcctaatcttattaaacggttcctgatatttcatcatcgaccccaactttgggttggaattgctatcttcttttggctcttttccaggattctgcagtcatcatttttcctttttaaaaattttcgcttctcagatatcaaggaagcagtcacaagattttgcttgatttctgattcagtatctcaaatttagtacaaaattgggtatctgtaaatttaaaattttaattcgaaaacatgggcctcgctagtatgccgtccgcatcagaaggaatgctatgcttgattctaatgaacactgctatgtcaatctcaatcgtcaaaggcatattcagatcaatcctcaaggttgtcggtttccagcttgctgactcatcatcgccaccgtattcatatttcgcatcacctcaagttgtctccgcagagccatatgatgtaaatttaagtcctccccttagctatgttgaggagttccgaaaccagaaccctgcaatcaagtatgaaacattgctccattgtgaagatgcagagcatgactgttctgtgtgtttgaccgagtttgagcctcaatctgatatcaataacttgtcttgtggacatttgtttcataaagtgtgcttggagaagtggctggactatttgaatgttacgtgcccgctttgcaggacacctctaattcctgagtttgaagacgatccctcttgcttctggtgagagtgttttatgagcttgtctagttgaggagacttctatgtacagcatgtagtgtacaggtatttactaatgcatcggccggagtgtagtgttgtttacacgccttctatgtgtnnnnnnnatctcgagtccttt

SEQ ID NO: 16931 - DNA, 850 bp, Citrus sinensis
  Predicted polypeptide sequence is orthologous to G2227
ggggcttgaaaaatctctcacaatcttaaacaagaaaaagtcttcggttcattaaacaaatgtcatcatcgccgacgacgacggagtcgttttggtgctacaggtgcctccgcatcgtcagctcgctatcccaattcgacggcgacaccacttgccctcattgccacggtggcttcatagaacaaatcgagacagaagtgatcaccaccacacaaacacaatcatcatcgcatgaccacatcagccgtccgttttcgacagccgtcatgttgggtcaagattccggtcaaagaacaaccttgagtttccagcgaagaagccgccgccggggaaactcccgcagccaacagcttgatttcttcaacccggtcatcgtcctacgcggcaacaataatgaagaaaacagtagcggcagcagctttgatctgtactatgaggacggtcaggggtcagagtcaactctaaggccgataccagaaagagttttagggttcttgatggattcaggatttcatctgttacttcatcaactgtctcagattgatctaacggcgctatcccggccggagaatctgccggcatcaaaagcttcgatcgagtcgatgccaagcatagagatttcgtcaggccacgtaagttcagagtgtcactgtgcagtatgtaaagaggcgtttgagcttggaaacgaggcgagagagatgccgtgcaagcatatataccatgaagattgtattctcccgtggctcaaaatgcgaaactcgtgcccggtttgcaggcaagagctaccagcagccgcagccgcacccgcagaagaatcgtcgatggcgctgtctatatggtggctgccggg

SEQ ID NO: 16932 - DNA, 927 bp, Citrus sinensis
  Predicted polypeptide sequence is orthologous to G2227
aaaatttagggtttttgaaattgctgattcttttgttcaagtctataaaaattgaacattagatctgaagggtttatcatttctgagtgaaaaatagaaactttcttctgttctttaatctatgtcttcaatcggattgtcgtactggtgctaccgctgcaaccggatcatccggattcaggccaggaccgaagacgcaatcgtttgccccgattgccataccggcttcatcgaacagattgaaaccattcggcgaccttcgaacgagagatatcccgccgccgaaatgtacttagacgacacccaaaacccggagacattcccgaccacgaggtttggtcggactcggagaaacggcggagaccgatcccctttcaaccctgtcatcgtcctccgtgggccccggacccctgattcaggcggtggaaatgaaggaactgccatggagagaggaaacttcgagcttttttatgacgacgctaccggggcgggtcttaggccattacccgcgagcatgtcggactttttgatgggttcgggttttgaccgggtcctcgaccagttaacacagttagattttaacggggtgacgaggttcgtgaaccctccggcttcaaaggctgcgatcgagtcaatgccggtggtcacaattgcagaaagccacgtggcgaaggaatcgcactgtgccgtttgtaaagagccattccagctcaattcggaggctcgtgagatgccgtgtaagcacatttatcatggtgaatgtattctcccttggctttcgatgcgcaactcgtgcccattgtgccggcgcgagttgccgaatgaagcaaatgacagaggcagcaatgtcggaggtggccccgatgagacgctggggttaacaatttggaggttgcccggtggcgggttcgctgtagggaggttcaa

SEQ ID NO: 16933 - DNA, 767 bp, Citrus sinensis
  Predicted polypeptide sequence is orthologous to G2239
gaggcctggggccttgccgaggaggattcgccaccttgcccaatcttcacgttaagacaatttaacggcgatttaactgctgtcaacaggttccttccgttcgaattccaaccatcgcccaatcccataccctcaccaccaactttaacgaaccccatcttcgaaacaaacggcggagtcattgaaaaaacccagcggtcggaccggccaatttgccggtccacataatttcttcctctactactcccttctcctccaccaccctttctggaactgccttccattgccagagcggcattgaaactcgccgttcgcttaagtttacctctcgtcattagctttttcctaacctcgtctggaaatcttagtgtgtacctctcaacgcttactccagctagaacaagcgaatgtcctgtcgaatgtgacctcggaaacctctctggcattcccaatctcggcggtcggttcctcatcggcgtcacgtgactcgccgcgttagtaatttcaagcacttgcgcgtcactgttgctttgctcgtcgttgatgtcgatcacagcgcgactttgctctccactgagttcagaagcggagttgttgtgagtctgattcgactcgttgtttgaatcgcataatttaacctttttgtttgattctggagtaaggttggccctacaaaccgggcacgtcacgtgagaggctaaccagacatcgatgcaatgaggatggaacacgtgatcacattttggaagtaaacgcagcgtttcgtc

SEQ ID NO: 16934 - DNA, 514 bp, Citrus sinensis
  Predicted polypeptide sequence is orthologous to G2239
gagcggttcacctttagactaccggttgatgtgaggaaacatataatgaaccggtgagctgaaccggtccaatagcttggtggttttgcccagggaagctagttcaaggaggggttaccgaccatgcggaggaggtgaaggtagtagtaaagggagaaatactcgggggctggaccggtctttcaaatcataccggtgggtgtttagcatggcaccgccatttttccaaagagcatcatcgcttaagactacaaaagtagcggccgatgatgcgcaaagtaattcggttcaaccggctggttcgtcgggtgagtcgagtcgaccgcccgtttgaacggcatattttatttttttaggtctaatttaattttaataataccacttttgtctagatttgtataatctttaaatttttttcttcatttttttcttgcataatttaattttaaagatcaatgtatgataattgacaatcctgaaagaagaagtcaattttgaaaaaaaaaaaaaaaaa

SEQ ID NO: 16935 - DNA, 726 bp, Citrus sinensis
  Predicted polypeptide sequence is orthologous to G2251
gaggcttctctcctctcctctccttactgttactactttttctcatttacatcttgcgtaagcaaaccttcaagtttctatcattcatgctgagttacatagtttcagtatctacccatttgaaatgggcatgcaaattcttgattcaaaactctctcttcggccatcggattggcatgcatggcgtgccagctgaaattggcgaggaactactgaccgttggacgctacgagcgcaacaatgataatgaggccgtagaatgtgcggtgtgtttatgcgagattgaagagggagaagagattagagagctgagatgtgatcatatctttcatagagtttgcttggatcaatgggttgggttattcaggcgggttacttgtcctctttgtcgtgattttctcgattcacgaagagctgttgtcgagaatgggattgagattttggtgtttaaaaggttttgttatctcgattcatcaagtgatcgtgattcatggtggttaaggtaaattctaaccatcttcataataaacatagatatatagaatttgcaaatttgtaaagctcaaatagcaacactctatatatattaagagtgcttgcttatgtatgtgcaagggaaacgtaaacaaaatcatgtgcgtgtattaacactctatataattaattaattattatccctctaatcttcaaaataagatagaatttgtgcaaaaaaaaaaaaaaaaa

SEQ ID NO: 16936 - DNA, 899 bp, Citrus sinensis
  Predicted polypeptide sequence is orthologous to G2295
ttaaatctataatggaagtcataaattcagaaactgggtaaaactaaaaaatcactgaacagcccctaactgaaatcaaaagaatagtagtaaaagtacttttttaacattgtccaatctctaaagctgtcctattgtttgagaaaccccacctgtgaagaagccttttcattcttcttggctggattgatctttgagaatatcattcgatttctttgcttgggcagcactgccatcataaatgcctgatgacgtgggagacatggtcagtgaggaattccaatttatttgtccttgaagtggggtgaatggaatcgtactaccagatcccccgccgcattgaatctccatgaaacttgaatcagatggtagcttttgactaacctgataagcaggctgcaaattgacaagtgattttgcatcatttgaatggtcatgctctaactttcttgatgtggccttattcacaacgttctgatctcttttgatcatgtttagtttcctgtccacatctttgagcttatcatccattgtgctgagaatcatcttcagttgatcctctgataaactgtccataccttgatcccatgtagtaaaatctcctacacaaattttcttgcaagcccttgtagctgcatcatcaacttgcctcatcttactttcgtcgaatttagacaaggataatgttctatgttgaccatgatcaactgcactaattttcttctcgtactttctgataatactggtcaattcaccttcctttgaggtccagggctctggcttcaaagagtggcctttgacttttggaccatagatgatgatgcatacttcaacatcgcacagagttgtaaactcataagccttcttcatcaaactgttctttctctttttaaaggttg

SEQ ID NO: 16937 - DNA, 655 bp, Citrus sinensis
  Predicted polypeptide sequence is orthologous to G2311
attaaatttcgtacatacattgctcatgtttcattgatcacaaatggacatgttacccaatgcacctggagtcatttggcgaagccatgaaagagggtgaagagttttccacaggatcaacaaatttacatactatgtcctccagatacactggctctctaccacttacatttgactgctcaagccaaaagaacaatttcaccacgtgaacctgcagttgaaacaccaaaatcatggaaaaagaatcaatcagggtcacatttcaaactatgagaatcgacaatgtgaaattgacgtctaaacaaaactacatcgttcatagatctctttcacaagctgtaacattgcatcagtatcttctgccatctttgagactctttctgcctccttaaatgcttcagcagccaaaaatgatttgttttcagcttcagcaattctataggcagcagtaattgatgcttcctccacaatctcacgagatgtcatcaatgcagaattccgtggtggtcgtaacctcgcatccttttgtttcggggtaggagttttcactccgatggaggtttcttttctaatcttgtaacagtttcggaccttttcaagtttgccttgtgaaacaagtcttctcaaccttgaactcaataatcttctaaaattt

SEQ ID NO: 16938 - DNA, 854 bp, Citrus sinensis
  Predicted polypeptide sequence is orthologous to G2319
tttttttttttttttttacaatggaggaaatgcgataattgcagccaaggttgcagtattcaacagcctaacgcatactccttattacaatatattcaaattgctctggcaacatgtatgatgtatccctaacatgttaaaatagcagcagcttatagaataactaccacaaaaaacgtactggatatacatttgttcactagaaataagcagagactaagaaacaaacattgaaacccactatcctgctgaaatatcatccagcaatctctccttgctacggtggccatggtatctccctacagactcaattggctcaaaatcaggactggacaaattgaggctgaggttcctcatcaataacaatactgtttcaaaatttatgggatccatttctttgagcttttgtacatggcctttggtgtctggatcaaaaacactccctatgaagctatacacttcagcgaagtctggaataccgtgaagaacgggaacttgattcccctgttttggcatgtctgtactaggttgtgttctagttgagcttccaatgccaccaacagtactattacctattcccgatatcccctttgatccaatatcatcagcttcgattgcgtgaagattggtatatttatcctgcgatggcatcattttttcagcatttaccagcatggaagcatcatcccaagcagcaaatccatgtgcaagggcatttactgatggataagccatggctgcttgaaggggcggtagaacatttttcgaggccttttgtgggtaaggatgagcagctttccgcttgggacgaggaggaggaacatgtgcaattgtcccattcttttgaaccttca

SEQ ID NO: 16939 - DNA, 263 bp, Citrus sinensis
  Predicted polypeptide sequence is orthologous to G2348
ccggtcttgctgttatgatttggttcatcccaagttcgaaggtgaccatgtccagacagaattgtacatgcttctctttagcttgctggattgcttgggattctcctgggaaaaaatatgctatatatattcttttattatacgaaattcagatagaggggcttccatgtgtataatgagaagctaattcgatcattagtggtatccgttttaatacgaaactccttgctaccgttactgtttaaaaaaaaaaaaaaaaaaaa

SEQ ID NO: 16940 - DNA, 924 bp, Citrus sinensis
  Predicted polypeptide sequence is orthologous to G2382
tttttttttttattgccgcgcgatttaaagcaggtcgtcggaaaaggtccccaatgttataaaacagcagctattgtttgatatgctaatcgacattacatatatgcgatcaggcctagatgcattacccactggcattctcaacagagacatcgttctcatcatcaagaccctgtcgtatttttgcaatctcagcctgtgctctctccataatctgcctcttctgcatttccaggtccctgtggaaatccatcctcatcttttctagttctaacatctgctgcctcttactattctcaatcttctcatatatctcactaaatttgtgaatagaatccgcaagcaatctaaacgaggacctatcatcagattcccttccaatcttccttttcttcggtggaagtccatctgaatcatcctcctcaccagcagtagattctgaatgccctggactatccctcatctcatccaccccatttgcacggttcaaatatgccctaggattcataaagacatactctcctgagtccatcccacaagacagtccaccttgttgctggggcgatgacattagcatatccattttcttgaaataaacccatttgctgccagtgtcgccagtctctgccatcctaagcttctccttcttatatttcttctttaatgtatacaaacggttcctacactgtgtgtctgtcctttcaatcttggacacctcagataccttctctgcaacttcttgccattcctcagatcgaagactcttcctcccacgttgcagaaaccggtcaccccaagcatctaataaaacaaatgtttcatgctcattcccatcggtaagtgcattccgcccaccagatgagggcctcagtgctggagtagccataaccggggtcggtactcgaggagcaaattcataacttg

SEQ ID NO: 16941 - DNA, 794 bp, Citrus sinensis
  Predicted polypeptide sequence is orthologous to G2404
tttttttttttttttttgaggaattcttgcttatgtatttaaaataataatctatacatcgggtagagggataaaatcattcatttgaagaacacctgcaccgaatgagatgcaagaaatcctctgggttctctagcatcggttcaccactgcagccttgcagacagggcaagcgtttttctgggaaagccattgttttatgcattgaatgtgaaagctgtgcccgcaatctagcttccccatctcatcatctgcttcgtattcctcctgacagatggtgcatttcttatcaacgtgcaagggcaaatgagatgatagatcatttataattgagttcttaagttttctaaggcaccggcctatctcatcttctttcagtccagtactcacataaccaattctgtcgcccagttcaagcagttcctcatacgacatgttgtcaacatcaagcctccagtcactaaagtgatcatgagaatctactcttccccccatcagcaaactattctggagcatcatcatctcagcaaggccatcaggagaaggatgtcgaacatgacgataatacctaggtccaaatacgtccaattcaggtcgagccaatgcaaagggagagtcaaaatccggaaaaggaaactcagagttcattgtccgccttgccaaacaacgctctctgtccctctctctttctctttctctatctctatctctatctctttccctttctctttccctttccctttccctctgatgatgattatcaatctttcctcttccgggaacaacattccttc

SEQ ID NO: 16942 - DNA, 909 bp, Citrus sinensis
  misc_feature (32)..(34): n is a, c, g, or t
  Predicted polypeptide sequence is orthologous to G2455
gcggggaaacaaaaaataaaagaaaagaaaannnactactatacatatactctcccctacacttcactcccgatcagacttgtcctttcagattttttccttctctttttatcaccattttctccctctctctctccaaataattattatttatacatgaaatcaaaccattttgttttgttttcttcttcttcttcgtctttgtctttcttttaatttgttcaagatttgattgattgataatagaactcttgcgtttctattgtttgtcggtacacttcttgatctccactgaaactatgtcactggacttgtcatctgaacgtgtttgttatgttcactgcaactactgcaacaccattttagcggtgagtgttccttgctcaagtttgttcaacattgtgactgttagatgtgggcattgcgccaatttgctaaatgtaaacatggtatctgcacttcaagcagttcctcttcaagaccctcagctgcagaaacaacacataaacctagaagattccattactaaggattgtggatcatcttcaaaatgcaataagttttcttcagcatttgagactgcagagcatgaaactcctcgaatgcctcctattcgtcccccagagaagagacaacgagttccttctgcatacaataggtttatcaaggaggaaatccaaaggattaaggccagtaaccctgacatcagccatagagaagcttttagcacagcagcaaaaaattgggcacattttcctcacattcactttggattaaagctggatggcaacaagcaagcaaaactagacaaggctgcagcctacgcagagggcactcaaaagtccaatggattctactaaaaacatctatataataagtatatgatgtgagtagatgcatgcagctcga

SEQ ID NO: 16943 - DNA, 878 bp, Citrus sinensis
  Predicted polypeptide sequence is orthologous to G2456
ggggaatgtgttcttcccgtactatattagtggtctctctctctctctctctctcattctctatttcttcttcctcttctttatatctatagtacttaacaatcaagaagatcagaacaagttgggattttatcatcccatcagtccactgatcagtcagtccatcaatcaatcaaatcaaaactaaaaaaattaaagaatcaggataatcaaagaaacaggatgtcatcctcaacacctgctgctttgtcaccggaccatctctcttcctccgagcagctctgttacgtccactgcaccttttgcgacactgtcctcgcggtgagtgttccttgcactagtttgttcaagactgtgacggttcgctgcggccattgcaccaatcttttgtctgtgaacatgcgcggcctgctgcttcctgcagctaatcagcttcatctgggtcatcctttcttcactcctcagaatcttctggaggagatccgaaatgtgccagctaatatgctgatgatcaatccgccaaatccagctgatcaatctgttatgcctgttcgagtagttgatcatcaagagatccctaagtctcctgttgttaacagacctccagaaaagagacagagagtcccatctgcctacaaccgcttcatcaaggacgagatccaacgcatcaaagctggaaatcctgatataagccacagagaggcctttagtgccgctgccaaaaattgggcccacttccctcacatccatttcggacttatgccatctgatcagcccgtgaagaaaactagcgtgcgccagcagcaggagggagaggacgcgatgataaaggatggtttctttgctcctgccgcaaatgttggtgtcactccttactg

SEQ ID NO: 16944 - DNA, 670 bp, Citrus sinensis
  Predicted polypeptide sequence is orthologous to G2456
ctctgttatgttcattgcaacctttgcgacactgtcctcgcggtgagtgttccttgcacgagtttattcaagactgtaacggttcgatgtggccactgcaccaatctcctccccgtgaacatgcgtggcttgcttctgccttcggctaatcaattccatttgggtcacaattttttctctccttctcataatcttcgggaagagatcccaaatccatctccaaactttctgatcaaccaaacaaacaccaatgatttcattgtacccactagaggtgtagttgatgagcttccaaggcctccagctaccagcagaccaccagagaagagacaaagagtcccctctgcgtacaaccgattcatcaaggacgagatccaacgcattaaggctggaaaccctgatatatcccacagagaagccttcagtgcggctgctaagaattgggcccacttcccacacattcactttggtcttgtgcctgaccatcagccggtcaagaaggctaacgtgcgccagcaggaaggagaagatgttctgatgaaagatggttttttcgcttcagcaaacgtggggtgtctcgccttattaagaatggcttgccattgcatattgctggttttaaatctaagttatgtcctttgttatgatctgtgcctgtgtcgtcctttat

SEQ ID NO: 16945 - DNA, 422 bp, Citrus sinensis
  Predicted polypeptide sequence is orthologous to G2522
gtcatcttctggtggctctgttacatacgaggggcgttttgagatattgtgcctttcgggctcttacctgctcagcggtaatggtggttcccgcagtcgatctggtggtctgagtgtctcccttgctagtccggatggacgtgtcatcggtggaggagttgggggaatgcttattgctgcaaacaatgttcaggtaattgtggggagtttcttgtggggaggtccaaagatgaaaaataagaagggggaagcttcagaaggcgttagagactcagaacatcagtcggtcgaaaacccagttactccaactactgctccatcgagtcaaaatctcactccaacctcttcagtaggtggcgtatgggctggttctcggcaaatggatatgatgcgcaatgctcacgttgacattgatttaatgc

SEQ ID NO: 16946 - DNA, 296 bp, Citrus sinensis
  Predicted polypeptide sequence is orthologous to G2531
gggggaaacagagacaggcaggatgagacaagataaattcaaggcattaagccaaaaaaactcttaaagcaaaaacagagggataccaggcatgcaagtgaaataagtgaagccgacaagcgtcatgacgttcttgaatcttgatgcctataatttattgatgctaccgcaagcgtttggtgaggtagaaaagaagaatgaccaaacaattggaactcattgtttctcatcatcaaacttcaaaaagtagataatcttcacaagcacaaaaaaaaaaaaaaaaaaaaaaaaaaaaa

SEQ ID NO: 16947 - DNA, 507 bp, Citrus sinensis
  Predicted polypeptide sequence is orthologous to G2536
ctaaaatacaagacaatggaggaactcccacctggttatcgtttctttccaacagaagaggagttggtttccttctatttaatcaacaagcttgaagagctatgcggagagaaatgtcaaggagacaccgagcaatggtttttcttcacgccgagacaagagagggaagaacggggcgggagaccgagcagaaccactgcttctgggtattggaaggccacaggctcaccgagctatgtatattcatccgataaccgggtgatcggggtaaagaagacgatggttttctataagggtaaggctccgactgggagaaaaaccaaatggaagatgcatgagtatagagccattgaaggagcatccaatccatccagagctgtcattcctaagttgaggcatgaattcagcctgtgccgaatctatgtgaaatccgaaagctttcgagcatttgatagacgcccgctggaagcagcaccgagagaggaacaacctcatggtggtggggct

SEQ ID NO: 16948 - DNA, 899 bp, Citrus sinensis
  Predicted polypeptide sequence is orthologous to G2539
ttaatacgtatgaggcggctattattaaatttattattgcttatctgaaggatttcagataagggattgacttaaccagaataggtgacaatgtgtatgtgcaattcaatatacattgtataatatatttcacttcaaattcagttaagtttggaaacagaattttattgtggtagtaataactttcaattatttcagcaagtcttggtaaacaacaatacgtaggttcatatacagtaacaagttttttcatggtgttattattctatttttgaatggtgttattatttttcaattttttattcctcgtttttttagaagtcctcttctgtgtgtagaacattgtgaacatggtcctcaaggacttcatggttcccaatgggatcacccgagatatattcttacgaattttcatcggttttaacagaagcacctaataagtaataaggtgggaagtatccttgctattatacttcctatagttattcaaatagaatcatctatttgattgattctccttttatatctatatataagatcgataaggaggggaggagaatctgtgcccctgggctctctctgggtttcttgatttttataataggaaccctaaatcactaagataaggaggagatttctgaaagctcgaagaatgattttacgtagggtgactacaattcttatttcttagttacagaaagcccttctcaaggaagtaagccaagagccactcatctgagccagctgattctaattctgctgcgccggtgcgcaaagcaagcacgcttagactgcgatgcgcaatatttggtctgcctatcattgtccattaagggtaagggctgactccgctagggcagaggaccactactgggattattcaactactaactgatgac

SEQ ID NO: 16949 - DNA, 920 bp, Citrus sinensis
  misc_feature (7)..(7): n is a, c, g, or t
  Predicted polypeptide sequence is orthologous to G2559
ttttttntttttttatttcataacctgagctcagactgtcatttcttattacgttatgattcaacattatttcaaacttttgcatacaaattgtatatacgcacaaatacatcaatatgcacgcacaataatgaacatttttccaattcttcataatgaattcaaacacaaacactaaataaacaaatgaatgctcaaaggaaatatacatagaattaaatttatcaaacaagcttgagaattttaacttccaaaacaactaaggagcttcttgggggcagagcccgtcgctcgatacttggcagccagctcctctgccttgagaaggtcttcccctctcttagcttcaatcattgccctcttttcttctgcttccttgtggattagtgccatcttgtttttcattttctctacatactcagccttcttcttctccaattgttcctcaatcttttttagctcagcttccacagctgctttccggctgttctcccatgaaacaatggaagatagctttttatgagctttgttctctgcttgcgacttctcactttcttcccatgctctaatcagcgaaatcctcttctccgtttcaactcttgcaagcaccgcatctctgtttacagagccctctgtacttttttcaccagcaggaggttcagcctcaggagccttatcaacaacagcaagggctttggattcctcaggcttatcctcagcaggtggagatggaattacggtcttgtcatcggcaacatctttaggaggctcagctgctgccggagcggctggttctgtaaaaggaggaggcggcggctcggtcggggtttcagtttcaagcttctttggttcctcctctgccatgtctctctctgctccgaaaccttaagcttaaagcaaagctgaagatctttacaaag

SEQ ID NO: 16950 - DNA, 884 bp, Citrus sinensis
  Predicted polypeptide sequence is orthologous to G2565
gggggaatcaggaaagaattttttcatcatctttttgatagcttgcgtacgcgcggttgggtggcttctaaaattctatccaatcatttgcttctcacaattcaatctctcgattctaacgtcagttacagtttcagcagagagggagccgatgtccaacccacaacagatttctgcatcgtcatcccgattcccagacaatatgcatctttcttctgtctcgccacatggaaggtactcccaaaattctcctttcatttctcaatcattaagagatgaagcaagattgcggtcgacccatttctctccatcagaaggacaacctacacctttgattaatcaccctgaggaaaataaggataattcctggtgtatagatccacttcaggattttcttgattttcctgaaaatgaccccggacagactggtctgctggaaagtaatactggtgatatcgcatctgatgatcgtgctaagagaattgagtggtgggcagatcagctcatctctgttgaagatggtccagaaccaaattggtctgaggttcttgctgatgttaatgtcacagatgccagacaaaaggtgctgaaaccatctacggatatcccaacacaacaccctcaagttcaccctcaagttcacccccaaggtcaacaacatcagcctgtgtcaaatgaagaatttcatgctgttgctaatccattgtccatgacaccagcaaacaaatccagaatgcgttggactccagaacttcatgaggcatttgtggaggctgtcaatcggctgggtggcggtgaacgagctactccaaaaggtgtcttaaagctcatgaatgttgaaaatctgaccatttatcatgttaaaagccacctccagaaatata

SEQ ID NO: 16951 - DNA, 481 bp, Citrus sinensis
  Predicted polypeptide sequence is orthologous to G2565
gttccgtcatgatcttagttctgcaaatggtggaggtttatcacatcgcagtaatagcagtcagcctgatcttaccagtcagacgtatgatgacagttcagatgatcatcaaggtggaggtacctctggaagatcgtcaaagaagcaaggtggagttgcgaataaagcctctgtcgtgcatccatcttctgtcccgaatctcgcagtagtcgggaatgcgccgcctttgaagaaagaaggaagtgtagtgaataagccagcagcagtagcagcgatcccaataaaaacctttaatgttgatttttaataacattcagttctttttaaatctggagaaggaaggaaggaagttgtattatattgtagataagccaagttattcttaattctgatgatatatagacatattggagcgagtttcttttttcttctcatttttgtataaataattcaaacattatgaaaaaaaaaaaaaaaaaaa

SEQ ID NO: 16952 - DNA, 663 bp, Citrus sinensis
  Predicted polypeptide sequence is orthologous to G2571
ttttttttttttttttttttttttttttgtaacgaggaaattgtaaaattcattaacagctgaaagttgaacaacaatcagtaacaactatatgttgtcacttcaggagccagatgatgctctactcagataacatgtttctgagtatgacaactgctacaactacagtgccttaataccaaaaacactaaggccaacttaatcatgacatcctctaattaagctaaatccgaacacgctaagaacaataggacagtataatttggtcttcgatactaccacttacacttaaaataccctctccctaattggcaagaacttcccaaatcaactcagggtcataagatggcaatcttgcaagcgaacagccttcaaaatctgattccacggtggtcgtcattggatgctcagttgaaacagatgtctgagaattttcccccttccaaaacccatcttcggaaacagttggtgaaaccaaatcaccatccccaaaaatcaaaggcgacatagttgaagatgatgaacaagaatcaacaactttctccactttctcactctcagtctcactaccaactttagacccaccatcacttaggatacaacttcttttggcactctttttagctctctctcttttcaccttttgacatattgcttgaatct

SEQ ID NO: 16953 - DNA, 310 bp, Citrus sinensis
  Predicted polypeptide sequence is orthologous to G2589
ttttttttaaacaaaacttttcattccatatcttattattactgtacatgacatggcggcaaacagtaagaacgaaagcgaagctattggttaacccagacaaccatcttaacaggggaaaaatttgttaaaagaacagggggatatatgaacaaaaaaagaaaaaagtaataatccagttagaaactttgctcacagtagagagataatcttcgaaaatttacgagcaacgacaccactagatcattactctatttacaaaggccaaaaaggttatatctaaggcatgatacaaaaaaaaaaaaaaaaa

SEQ ID NO: 16954 - DNA, 453 bp, Citrus sinensis
  Predicted polypeptide sequence is orthologous to G2592, G2713
ggggaagactcgttgcggagcttctcaaaatcaattgacgtttcaaccgaatttagcagctcacggttctccgatattgttggaccccgtgatgaagaagatgagggaaaggatagacccctgattcttcggaataaggcaccaagatggcatgaacaactgcagtgttggtgcctcaacttccgtgggagggtgactgttgcatcagtcaagaatttccagctgattgctgcaactcagcctgcagctggtgcgcccacaccatcgcagccacccccgccgcccccgtcagatcacgataagattattctgcaatttggcaaagttggtaaggatatgttcacaatggattaccggtatcctctgtctgcatttcaggcttttgcgatctgcttgagtagtttcgacaccaaattggcatgtaaaaaaaaaaaaaaaaaaaaaaaaaaaaaa

SEQ ID NO: 16955 - DNA, 801 bp, Citrus sinensis
  Predicted polypeptide sequence is orthologous to G2592, G2713
tttttttttttttttttattcataatatgactgacaaataaagataatgtctcaaaggtaacaatatgattcaagtttacaattatataattcctgccgctagagttacaattgaaattttacaataaatgaataacattaacagcaattccctatcctgcactgaacgtataggaaacaaattacaaagaaaaatggggaaaagagatgtcgcagtccaccaaacttttgatatctatcatttattgttctattcacaggccagtttggtgtcaaagctgctcaagcaaatagcaaacgcctgaaatgcaaagagtggataacgatagtccatagtaaacatatctttcccaaccttgccaaactggagaatgatcttatcatgttcaggtggcgctggttgagagggagtgggtgcaccggcagctggttgtgtagctgcaatcaactgaaaattcttaacagatgcgacagtcacccgcccccgaaaattgagacaccaacactgtaattgttcatgccatcttgggggcttgtttttgaggatcaagggtctcaatttgccatcctcatcatcctctctaagcgcaccaatttcagaaaatcgtgcgctgctgaagtcaacagagtgatccagtgattttgagaaggagatgctccggaatgagtcctcaagagagcggggaagaagctctggctggccaggaacagagccacctacatcaattgatgaggctgggattgagtgcatgatgcagtgcatccttctggggcctcgtgtgccaagcacattgagttcat

SEQ ID NO: 16956 - DNA, 874 bp, Citrus sinensis
  Predicted polypeptide sequence is orthologous to G2604
ggggggtataactttgcagtatatccactctttttttctccttctttccagtctccacttcatctgcaagttgcaaaggcatggtcaaaatgggaggaagaattgatcttttctgtttttgaggcaacaaacttttaggagcttggaagagaaagacaataactgtaagatattgcaatgccagttcctcttgctccttatccaacacctccagcgccatatactcctcctgccaatggtgcacagagccagcttgtttgttctggatgtagaaatctcttgctctatccagttggagcgacttccgtatgttgtgctgtttgcaatgcagtaactgcggtgccacccccaggcacagaaatggcccagttggtctgcggaggctgccacaccttactcatgtacatacgtggagcaacaagtgtacaatgctcttgttgtcacactgttaatctagccttggaagcaaatcaggttgcacacgtcaattgtgggaactgcaggatgctgctgatgtaccaatatggagcacgatctgttaaatgtgctgtttgcaattttgtgacagcagttggggcctcaacaagtactactgagcagaagttcaatacttgaaactactgcgcattgaacttagctagtacagactcgacggcttcagttttgattacgacaatatcccaccaactatttaatgatcggaggataatccctctattcactgtatagagttactttctcttgcgtgacatctcaatcaataaagaagtttcggctagctgaatgtatgggaaagtattctgtgtgaagacttataggttgtgaatgtatttgcaaatccttggataagttaaaatttgtttttctttgcttc

SEQ ID NO: 16957 - DNA, 749 bp, Citrus sinensis
  Predicted polypeptide sequence is orthologous to G2655
gccaaataatcgtcccaagagacggcgagccaagagcagaaagaaccaagaagagattgagaatcaaagaatgactcacattgctgttgaacgcaatagaagaaagcaaatgaatgaatatctctcggttctgcgatctctaatgcctgattcttatgttcaaaggggtgatcaagcatctataattggaggtgccattaactttgttaaggagctggagcagaggctgcaatcccttggtgccagaaaggaaatcaaagaaaattctgaaagtggctcaacattattcgctgaattttttgcatttccacaatactcaacaagttcaagtcgctctgagagtgaagcaataatgagtaatgagactcaaaattcaatagctgatattgaagtaaacatggtggagagccatgctaatctcaaaataagatcaaaacggcggccgaagcagctcttgaagcttgtttctgggctccaaagcatgcgccttacactcttgcacctcaatgttaccactgctgatgaaattgttctctattctctcagtgtcaaggtagaagatgactgtaatctaacttcaggggatgacattgcaacggccgtttatcaattgttaggtaggattcaagaagatgcttcgttgaattgatgaatcaataatttattacccactgtacttggctctattttatttttttatctttcataaaccatttgtgggtactttctttgtttttaattaggctgta

SEQ ID NO: 16958 - DNA, 817 bp, Citrus sinensis
  Predicted polypeptide sequence is orthologous to G2747
gaggggcaaactaaaccgacttgtgataccgaaacaacacgccgagaagtacttcccgcttgactcttcgtcgaacgaaaaaggccttcttttgaacttcgaggatcggaacggcaaggcctggaggttcaggtattcgtactggaacagcagccagagctatgtgatgactaaaggctggagccgctttgtgaaggataagaagcttgatgctggcgacaccgtgtcctttcagcgcggcgttggggagctggggaaagatcgcctgtacattgattggaggcgcaggcctgatgttcatcatgttccagatcccacgacgcttgcacaaatgcagtttcaaaatcagctccgctttcagcagtcgctgcgctggggcaccaggctctactcgctcccccaatctttgtcaaattatggtcctttcagttacaatacgattcacaatccttattaccaacatcatcaacaacaacagattcttggttttggtggcaatgcgtcatcgacgatgccggtacagtattacctaaggccatcgtcagtttcacagcaaattgagggagggcatatgccgatggtgattgattctgtgcctgtcgttgttccgggcaaaactgccagctctactgcagcaaagcggctaaggctgttcggggtaaacatggactgccctacacaagatgatcaatctccagccactagtagtagttccacaaggcaagctgcagcatctgagtattcaagcaaaggaaaatcttccttgtcttttgatttggatctataatttgctatatgcattaatataatttcaagg

SEQ ID NO: 16959 - DNA, 798 bp, Citrus sinensis
  Predicted polypeptide sequence is orthologous to G2754
tttttttttttttttttacaacgtaaaaaaagagcattttcaatcatttctccgctcacaaaattgcacgtagctctttgaacctcaaggacaagacccaaagaatttgaaattcaaaaggtgaagaggttccactacgccgaatctgtggacaatgcgagcaccaaaatttcatccatagctgcctagtgtccatgcatttggcaaatctggttttacgttcaacaaatatagtgcaggtatgaaacttctaataaacatgtacaaaaggggactggctatctccggaaaatgcagccctttatagtgtccgcaggaaaagagcatttcaatcatttctctgctcccaaaaattgcacatagctcttcgatcgttagggacaagacccaaacagtttgaaattcaaaaggtgagagactccactgtgccgaatccacggaaaggatccttaactattgagagtggagagcatgcctccagttgctgttggtatcaccacttcccaaccaggtcctttaagagggtaaacagcagcattaggcttttcctcatcatccaaacaaccagcaatgaggtcggcacgatccaacaccctctccaaatcttcctcgccgatatctgtctgaatcattttgtcttcagcagtttcttcatcctggagaagtgcgagtaaatcctcttcctccaaggcatctatacaattagacttggtccgttcttgatgaaactgcccttttccaatcacaacatgctcaagcttcagcttactgaaagctcttttcaatatgcgaccctca

SEQ ID NO: 16960 - DNA, 954 bp, Citrus sinensis
  Predicted polypeptide sequence is orthologous to G2779, G2859
cttttctgtaaagcgctgagttgaagagttgctaaacttgtctaatggcattagagaatcgtaacacatctgatgatcagcctgctggagtcatgggttttttctcaaatggcagcttttttgatcatcatcaacagcctcagctttgcatgagctttgctgataacaacattcaaagtgaagccttagttgttccttccataggattgatagctgatttcagccatgataccagtaacggaaagaaggcggcggcgcatactgttgaaagttttatgaatttgtctcccactccggcttctggaagtgggttgttaagtgtaaataataagggaactggcatgcagggcttgagtggaagaaaaagaaagagaaacaatgagagagtggtggagaaaccaaaagaagtgattcatgtaagagcaaaaagaggtcaagccactgacagtcacagtttggctgaaagggtgagaagagagaaaataaatgagaggctgagatgcttacaggacttggttccaggatgctacaagacaatgggaatggcagtgatgttggatgttattattaattatgttcgatctctgcagaatcaaattgagtttctctccatgaagctttcagcagcaagtatgtactatgacttcaactcggagctggatacaacagaaacaatgccggggacaaatgaatgtgatgcacaagacatggagaggatggtgagagaagggtatggaggcccttcttacttccactctgcttggtctctttgaatgcaagacttaaatataaatttcctatgttcttgcttatcaaaagaagttgcaaattaaaccctgttgtatacaccatatatatgcttatggcaataaacaataattataaagaaaagcaaggatactgtaatctcgtattaattcccgtataaatataattaatgcatgtaaaaaaaaa

SEQ ID NO: 16961 - DNA, 940 bp, Citrus sinensis
  Predicted polypeptide sequence is orthologous to G2783
gtttctttctcgcttcagagttcggattattctctcgttcaatctcaataacgatcatgatgcagccagcgcccggagcggtcccacccccgccaccaccgatggccgctcaccagtaccaataccaacaacaggcgccgcctcagcagcagccgccaccgcaaccctcgccgtacatgatgatgatgccgcctcagccccaggcccagcctcctgccatgtgggccacgcaggctgctgctcctcaggcggcgggagttgcggtaccacctcagcagcagggtcagcccggtgagatccggaccctgtggatcggggacttgcagtattggatggatgagacctatctcaacacttgttttgcacacaccggcgaggttgtcgctgtaaaagtaattcgtaataagcaaactggtcaaatagaaggttatggatttattgagtttatttcgcgtgctggtgctgaaagagttttgcagacatttaacggtacccctatgccaaacggtgagcagaacttcaggctaaactgggcatcttttggtgctggcgagaagcgcgatgacacccctgaccacacaatatttgttggagatttggctgctgacgttactgattacatgcttcaagagaccttcagggcccgctatccctctactaaaggtgcaaaggttgtcattgataggcttactggacgcacaaagggttatggatttgtgagatttggtgatgaaagtgaacagctacgtgccatgactgagatgaatggtgtcttttgttctacgagaccaatgcggattggtccagctactaataagaaaactgtttcaggtcagcagcagtaccctaaagcttcatatcagaattctcaagtggcacagagtgatgacgatccaaataatacaacggtgtttgttggtaatctggactctattgttac

SEQ ID NO: 16962 - DNA, 735 bp, Citrus sinensis
  Predicted polypeptide sequence is orthologous to G2790
agttgtcaaatctgtttagcttaataaggcagaaacgaggcaaaaaccatgtacataacttttgacactatggaaaaagaaacagattcacttcaactgctgctgctttgtaattgttaccgctggtgctcctgctggtgatgaaacgttgctccccatggcaggtgcccagaaatcagcaccgttgctgttcgccacgtgtacggtgcacgccacggggaccagacacagtcccttgctcttcaaatcctttcttgattcttctcctccgttttctccgccctcaggttggtggtgttgcaggtacggcgagcacaggacctgaacctgatcgtgcaggaacctgatatatcccatcgcttcatgcagcactgatgctgtatctgtcttgccaaagggtgacacaagttgctgcaatgccgtgattcggtcacctagcttctctttcttggcctttgcatgggctgtagatgatgggttatcggcagcttttgtctttttgctggttctctggcttaccactggagatgttgtggtagctaaatttgagcgcggaacagattcttgggctgacccatttctctttttggtagatttggagggagtatttgcactgctgttgttaccagaagaagctgaagaagaatcactacaagttatgccagattttggagtagcagcagcagtagctgttgtttcaccatacacaacaatatcaccatcattttgcttatt

SEQ ID NO: 16963 - DNA, 904 bp, Citrus sinensis
  Predicted polypeptide sequence is orthologous to G2791
ttttttatcccatctgagaaattaaaaatttaataatagtaaaattaacaaaacctaacccgcaaattaaaataataataataacataaaataaggtttttgttcttgggattggcttctttcttgcttttttgttgtttgttagattcagtcacaaagtctacacaaatacgacgtcgtgaaggtccaacatctagtgacgccttattttcgtagactttggacgagccgcatcataaagtcggtcgacgccgttgatcaaggcttggaaacggaagcagcatctttgacggagccgtcagccccaccgttacccatagttgctgactggacagtcagcactgacatgctaggtgaggtcgggccctcaccattggactgaagcaaaggattgtggtggggattgccgttgttattgttgttgttgctggtgctgatgatggggttcctagagtgacacgtggcagtcgatatagcagttgcaagtgagatgggcattagacaaagccctttgccttgtaagtactgcatggctgaccccatatcttcttccatcagcttagccacttggtgttccgtcacagttaagctgtcgttagctgacgtcgtctgagctccgttagggttccgcccgtttgcttggatacaatcacctcctcctccctctgaggacatatcagcaacaaggggtgcgacagcagcagcaccgcccaatctactcatgctcaggaccttcacttgcagctggaggaatttgacatagtcaatgatctcatccagcatcgaagccttatctgtcttgttggcattaggtacaagttcttgaagagctttcattctctctgcaattctctctctgcgcaatctttcagctatgctgtgagggtcagtagcttgacctctc

SEQ ID NO: 16964 - DNA, 390 bp, Citrus sinensis
  Predicted polypeptide sequence is orthologous to G2802
aaatgtgttttatgaaaataatatctccacaaaatataaacacatgtttgtatatttctctctctctctctctctctctctctcttttttaggcgtgtttgagtgtcttcaaaagaaagtggatgataactcataagccctttttccatgcgtagcattgagagtaaaacacaccatcagacaatttgatagtgggaataaaaagagaagaaagaggcaactcctatatatagatgaaccctaaccctaatttttgacatgcttgtatttgtttgcaggaatcatcaatgacaaacccacaagaggcagaatggttgaagtactcctccttctggcctgatcctgacaaccaggatcatcatgggtaggcgcaaaatataaaaaaaaaaa

SEQ ID NO: 16965 - DNA, 837 bp, Citrus sinensis
  Predicted polypeptide sequence is orthologous to G2834
tccccctgggctgcaggtttatccataggtgagttcaggaaatggcatttgctggcatctttgtactatcctgtggtaatttatcatgtttgaaaaataccccacttcgaaaattattgccaatatttgaaaggccccccaaaggagagaaattagattaacaaccaaaagcaggcttgaatacccaaagtatacaacagcaactttcttttacaataccaaattacgcgaaataaaaggcttgaagaacagtattcttctaaaattggttataatctacaaagaagcaaagcaaaaaacttaagacgagaagtacaaatctctctacagtctactatttcggcaaaggagagccagtcgggctccagaatggattctgatgttcgagataggcggctacaggtttcaggttgtttccattttctccgttgtaatcattgaagaggggattatttccaacgttcttagagctaccactagtacaatcttcatgcccagaaaacttttgttgcttgagtggaaatgaacgatccttacgagcaaagagatttgggtgaccattttcatcatcgtcatcatcaaaagttgtccatcgcattgagttgctgtgcttcttctccctcgctgcatttcgcatactctccatgtctcctacgtgatccttgaactcttttttcaccacatccaacacaacatctccataacgatcacaccatgacctagaacattccacaagaaaacacagttgagaaatgagatcagctaggaaagaaatgacttgtcccattcattatacttttgactgccctttttcttttttccttcccccaactaaaa

SEQ ID NO: 16966 - DNA, 654 bp, Citrus sinensis
  Predicted polypeptide sequence is orthologous to G2834
tttttttttttttttttaatgaacagcattttattcaagatgaacaaattacatgaacatgggagaacaatgacttacaaatataacagaacttagaatcatagacctccttacagaagcataaacctaaacatagaaacatcatttgagagtattcaaactcgtctccccaccagttttctgaatgtaattacaggacccaggaataagaaaagagaatgcattctccgaatcatcaaatgggggtcgaggaaactcatgaaatccatcaaagttacacgtatcaaaattcaatggtgagaaataattagttggatcatcaacattacccttagcatccatatcgctaactccagttccattaggaacactagatccaaagttgaaatttgtacttccaatcttacttgttgcttcattgccttctctccgatcagatggccctgccagtcctttgatagtttcatcaagtggaatggcaggagtatggccctggaacaatgcaatgtgtccaaacagcttgtctttccttgagaacgttgtaccacaggaacaaagccatttatccttgccacagtgcttctcgtgagttttgagatcagcaataactgagaattttttggtgttgcatctgctacaaacatagcttttgtc

SEQ ID NO: 16967 - DNA, 972 bp, Citrus sinensis
  Predicted polypeptide sequence is orthologous to G2854
gaagaggagccatggacatcattttcaggccattttcacagaggttcagaagactgttagaaggtgaagaaggaacgctgcctgatgctgccagggaacacattcagaatctctataccgacatagttacttccttgctaagtaactatgacgacgggttgttccagattctgctccaaagctttggaaaagaacaaacagattttccagaactgtttgtttgaaggaactacgcccccatgactgtctaatgctttgtcctcctaattgggtgccattcaaaactgatagcgcttgctccgcacaagttctcttagcaaactgaacaaacccgcagcgcttgcccactggtaatttcacatgaactaactcaccatattgaccaaaaactgttttcaaaatgtcatctgtaacactaggatccaaacccccaacaaatattgttgtattatttggatcattctcgccccggcttccttgggtattctgataaggagctaaaatgaggccacgcattaaagtggaatcatttcacccgaaatcggttccaggccccctcaaaatgagagcctcttggtgtcctctaagatagttgcatataatcaacaaacttcaacttatggcttcaatgttgcatcaggatttcaggacatgtagtgaaactcagagaatcccatctccatctgagaaacatgttggaggatgcaccatttgaggagtcttttaacttctaaacttttacggtggcttgttgcttcagtaattctagggaagctttttgggaaactggacatcccaggttccaagctttcaaaaagtccattttttgaagtgcactcttttgtgcaagcgatagcaggcggcctttgcagtaatcatcatcatcttcccactcgagagtttcaagccactgtgtttctgctcttacttcaaccaattttggtgcactacttgcatccataggaagtatca

SEQ ID NO: 16968 - DNA, 914 bp, Citrus sinensis
  Predicted polypeptide sequence is orthologous to G2854
gccccccctcagtttaccctcttcatcggatctcgaaaatcaattaataacgctttagtaattgatataacgatgatgcaacaaccgccatcacagccttccgatcagactagccagtaccagcagcaacatcagcagtggatggcgtatcaacagcagtcgcagcagcagcaacaacaacatcaaactccggtgccacctccggttggatggactccgcagccggtgcctcctccatctcagcagacgcagccctacggtgtcgcccccgatgcttcctccgacgggatccgttctttgtggatcggagacttgcagccgtggatggaggagagttatatcgccagcatcttcggccatactggagagtttgtttcaggaaaggttattcgcaacaagcaaacaaatttttcagagggttatggttttattgagtttgttagtcatgctgctgcagagagggttttgcagacttttaatggcacccaaatgccaagcactgagcaaaacttcagactgaattgggcaacctatggggctggtgagaggcgtcaagatgatggtcctgattttacaatttttgtgggagatttggctgccgatgtaactgactatgtgctacaagaaacatttagagctgtctactcgtcagtgaagggtgctaaagtggtcactgatagaaccactggacgctctaaggggtatggttttgtgagatttggggatgaaagtgaacaattgcgttccatgaccgaaatgaatggcgtgctctgctctactagacctatgcggattgggccagctgccaccaagaaagctgccactggccagcaatatcagaaagctacttatcaaaatacccaaggaagccagggcgagaatgatccaaataatacaacaatatttggttgggg

SEQ ID NO: 16969 - DNA, 570 bp, Citrus sinensis
  Predicted polypeptide sequence is orthologous to G2854
tttttttttttttttttagaaaaaagcatttaaataacaataagtagtacccccaaaaattttatgaaaatgaacgttcataccacacatagcgatattaaaaaaaaaaaaagggtacaaagcccgaactggtttcccccaaaaaggacaggaaaaaaaatcattggagtaatatccccccattaagttactgctacaaaaaaaagcagtcccataaacaaaaaccccccatcaatatccccttcccacggggggggttgcgggggctgctgaaaatttccatatccgggatatcccccgtaatacatgctagggtcttggggaacaccccccccataaccataattctcataaccttgggcatatccctagtatcccgcattcccctggtttgggtctgggtgaacctgtttgtttgaaggactacctccccctgaaagccggaaattttgtccccccaactgagttccatttaacattctcaaggcttcccctgcacaacttctgtcagcaaattgaacaaatccccatcccttgcccggggggattttcccatggactagttgccca

SEQ ID NO: 16970 - DNA, 869 bp, Citrus sinensis
  Predicted polypeptide sequence is orthologous to G2930
tctgagtaatagttatttgcttggcacttcttggcaaaactaaagagaacatagaaaattattaacctcttatgcaaaatgaagaaattaaagtaaccatgaaatcacatcttgtctcaaaacttcgacatagtcagttgcaagcgaatccttttgcatctgtatatgtaaatggtagcaaactctcttctcacaaacacagagagttgagacactaataatgcctttttcttttgcttctaaattctgcaatagttttgagaaaacagttttttcatcattcggactgcatataatttgtatgataacatcacctttttcaacttcatgcaccaaaactgagggagcttcatgttctaattgtagattttggttgtggcgttgcttattttcaattttcgatagcatattatccttcttgagagtcagcttttctatctcattttctagctctggaatgtattcgagagctctatcaatgattgctggtgcactccttttctttttactttctgaatccggtagcaaagcaccaagagataagtaggttgcataaagcttcatccttcgtactctttccttggcattatgctcttcaattgttgtgttgtttctctcctttttcttggcactcagttgtttttcaggcaatgccttattgatgctgggggtggccacagctgaagtttctctctcagataagaagcttgattccaaccctctactactttcatggttttctaaaggcagcgatgagcagcctgcctctccatgaacccaaggatcaccagaagcttcagcaaaatgtgaaaaaatgtcatcattgcagtaattgactagattttgcagaaataattctgtgtccgtgc

SEQ ID NO: 16971 - DNA, 682 bp, Citrus sinensis
  misc_feature (630)..(630): n is a, c, g, or t
  misc_feature (633)..(633): n is a, c, g, or t
  misc_feature (635)..(635): n is a, c, g, or t
  Predicted polypeptide sequence is orthologous to G2969
agttcaagttcatgaacctgaaacgggcaatgttggtctgccgggtcgtggcgggccgggtcgggtgcgatgcagatgacgacgtggatatggcgaaggagaatggcgggtttgactcggtcgtcgggaggggtgccggtggggtcaactcaagagtggacgacgatgaggagcttttggtctttaatcccagggctgtgcttccttgctttgtgattgtgtacactgtgtaatgacggtggtgttgggagtgtgtgttctgttaaatctcctgagaaacttcaatctgcaatctgtatgtacgtaaccttattttgtgacaaagttttttactgtaaatgtgcggtggcgatggagttctggttgccggttcttgatgtgggtcccaatatacgtgcccgtgtgactgcttgctgtagtttaatttgtcctacttagtcaaatgcatgataatctatcgaatggtgttgcggctatcatggtcgcagcggcccgtaaaatttctctctttctttctttcgttttctccccaaaacaactactaatcgtgatcagcacaatgatggtggttggttgagtacaactgatcggcataatgacaatttagtagtacaatgttctgaaaatcanaanangcagctgggagctcgtccgatcaacaacgaagagatctcggaggagt

SEQ ID NO: 16972 - DNA, 812 bp, Citrus sinensis
  Predicted polypeptide sequence is orthologous to G2994
ttgccctttaacaatggcacgaaaattattattttttagaaaaaaaaagtgtccccaccacaataaacaggtagcaaagagacgagagcatatgagacacttccttttttttttgggggcctattttctttttccttatctgaacaactgttacaatgatactttctaaccgaaatggacaattttttttttcaaccttccctttctctgttccaagaaagccacccaaaactcccaacatatttcattttacaaccccggaatgagtttacaaacaaaccattgtagttacaaagtgcttttacctctctttgttctttggattctgcttcagctgtacaaaaagactgacaagctaacactacataagggctttttctcctgttccttctaagaagaaagcgaggagcggtaaacaaaaaaaaaaaaaaaagggagggaagggagaaaattacagctcaagggaagtaattaagttacagctacaattataacatttgactgtgatgcttcttcttcttttgtattctttctttctttctttaattttcttttttaacctgtggtccaaacgacttcaactaatgaaattaaagacaaaaatagtacaacaaagaaaggaatggctgacccacttccttcacagcatttttacgtatgcaaattttgtatggtagtaagtagtagcggtatagtacccaatatccagcccataccgaacgtgtaggatgaggatgacggtggtgatgatggtagtaggattggaagctgtggtggttccctacagtctctgatgtaagtttttttttttg

SEQ ID NO: 16973 - DNA, 738 bp, Citrus sinensis
  Predicted polypeptide sequence is orthologous to G2997
tttttttttttttttttagcaacaataatgtactaattaataattaagaaacatcatcctccatctccatcctctagctaggagctacactacactcagcattgatcataattaattaaacggggggaaaaaaaaaaagaaaaaagaaaaccaaattgaaagtaaaaagggagtaattaattaattaattaaagaaaactgtctaatatatatctctgctaaattgaagtcaatggaataaaattttgtttgttcagtcccaatgatactgtttcttcgatcgaggttgttatttcttggaaaaattattagggtttcttaccaagtgggtgcttgttattatgcatccaaaccttaagcacatgccttttgacaccagtctcagcgcaaaactgctccactgaagcctcatcgggcttctggattctccagcccagctgctcagcaaaccctaacatcttctccttttgctcagctgggaacttcgttctgggccttttcttcgttccgccacttcccccgccgctgctgcttggattcgacacatcttcctcttctctactatagccaccggctgacgacgacggaagcgctaacggcctcggctgggcagctgtcaagtgcaagtacccagctggagccggaggcggaggcccccgatagtaaggcgaaaattgctgctgctggtgatggtaggccaacggcgaggcgccgtcagtttccttacggtggaaattc

SEQ ID NO: 16974 - DNA, 863 bp, Citrus sinensis
  Predicted polypeptide sequence is orthologous to G3055
tttttttttttttttttattttttttttttttagaaaacgtaatttgtaaattcaacacagaggtacagatgtctttcacaaagttgtgtggtcatctagcaacatcatatctgacaagcagctaaagactacaaagtacaagcttcaaatttccaaacccgaggttgaatgctactcatgctatcgaacaagaagctgagagtcggaaaataaggaagactttcttatccaagcgcagatacatgatcctaggagcatattaggagtatcaaaacattctgtcttccagacaaagctgtttcatggaagctttttcagttttcatcatatttcttcaacatgtagtaagattcaggatttcatattctattcaatatcatcaatccagtcaccatatatccgactgattttgtccggacccttccatttttcgtgagatctttgccccggcctctggactacaatagacgatctttgtgatggaactcccatatggtaaacatctgcatgaggcactgaagtaactgatgcaaccacagtatcaactggtgtttttgaaggcactcctactagctttgagtcggaaggggcagcagaagaatcattattttccgactccacaaggcctccaccaaatcggtgtaattcttgaatcccatgcgcaaaatgacatttattcccaaatgggcagtaccccgtaagctcccacttgttgcaaatcctagtcttccaattggatggcttcacattagatactccaatattatttccagcagcagcagcagctgctccccctccaccatagcctccaggccccaaacttattgccacactctccctattcttgctctgttcatcatgc

SEQ ID NO: 16975 - DNA, 791 bp, Citrus sinensis
  Predicted polypeptide sequence is orthologous to G3060
ggggattttcacaaactgtcctcccaatttttttttctccctcttcaattcgagccctagctttctctcactagggttcttgccccccaaaattttctcgcactttctctcacgctttcccgcactttctcgccgcttttttccttttcgctccgctcggtcgcgtgcttcgacttcggatcccggcggttgtttctctcgtaatggagctcggtggcggccgcaagaggggaaggcatgacggtgcctcgaatggcaatggcggctttaagaaatcaaagcaagaaatggagaactttccaactggtataggaagcgaatcgaagccatgcacaaagtttttcagtacttctgggtgccctttcggagagggatgtcacttcttgcattacgttcctggtggtttcaaagctgtctcccagatgctgaatcttggtggcacccctgctcatccaccaccacctcctagaaattcaggagccccaccatcctttccagatggctcatctcccccagctgtgaaatctcgtttgtgcaacaaatacaactcagctgaaggttgcaagtttggcgataaatgccattttgctcatggtgaatgggagcttggcaggccaactgtgccatcctatgaagatcctcgtgccatgggaggaccgatgcatggcaggatgggtggtcggcttgagcctcctccacaatcactgggagctgcagccagttttggggcctcggccactgctaagattagcattgacgctaagcttgcaggagctatcaggggcaaaatg

SEQ ID NO: 16976 - DNA, 458 bp, Citrus sinensis
  misc_feature (33)..(35): n is a, c, g, or t
  Predicted polypeptide sequence is orthologous to G3060
gggaggttgatcccaacttaaggaacattgagnnngaggggacattcgatcagatcaagcaagccagtgctatggttcgtgagttaatcataaatgttggttctggttctggacattcaatgaagtcaaattcctcttctcagtcaaacaacttcaagacgaagctctgtgagaactttgcaaaagggtcttgtaccttcggcgataggtgccactttgcacacggatctgaggaattgcgcaaatcagtgatatgaccttgcttttgtttcatcttgttccctttatgtgttaggactaatttgttgtcatagcctttgtatttggcgtgtctattaagttttgctttttcggatgcaaaaattagacatactgcagatgcacaagagttagtttctttcttattaattttttagtgtatttgttttaaaaaaaaaaaaaaaaaaaaaaaaaaaaaa

SEQ ID NO: 16977 - DNA, 647 bp, Citrus sinensis
  Predicted polypeptide sequence is orthologous to G3067
gcaatcaagctggctaaagaaacaaacacccatttgcaagatcgaccgaatcctgaaagtccacaacactcaaagaaccatagccaagtttgaagagtacagagactccattaaggcaaaggccaccaagctcccaaaaaagcacccacgctgcatagcagatggcaatgaactccttaggtttcactgcaccactttcacatgttcacttggcctaaacggatcctcaaacttgtgcaactcaataccacaatgcaatgtgtgtagtatcatcaagaatggcttcaaagttacacaagaaaccaacaaaggactccgtggaaatggcattttgacaactgcaacaagtgggaaagctcatgataaagctggagttgaagatgggagtgatgcaagggcaatgctggtgtgtagggtaattgcgggaagagtgaagaagagcatggagggtaacctagaagaatatgattcagtggctggtgccatgggcatgtactctaatttggatgaattgtatgtgtttaaccctaaggctatattgccttgtttcgttgtaatctacagtgggttctaataatttgttaagtttgttaaaacattttgttaattaagttaattacgtttcttgttaaaaaaaaaaaaaaaaa

SEQ ID NO: 16978 - DNA, 906 bp, Citrus sinensis
  Predicted polypeptide sequence is orthologous to G3083
gagagagtagggacccaactatttaaaaaatgtcgtcgtcaagcttcagcagcttctacagcacgtggttcgagcagctgaaccagctggtccagcaactctcggcggctgctcgaccgcccacgacctacgaccagcaccaggacctggagaagctggtcgccaagaccctgacccactacaccgagtactacaaggtcaagtccgccgaggcccaacgcgacgtgttcaacgtgttcgcagctccctgggcttcttccctcgaacggtcactccattggatcgcggggtggcggcccacaactgtgtttcatttggtgtacacggagtcaagcaccctctttgagtctcatattgttgatatccttcgtggcctcagaaccggtgaccttggtgacctctcccccagccagttcagacgagtgagcgagttgcaatgcgaaacggtgaaagaagagaatgcaatcacggacgagttatcggagtggcaagatggggccagtgagttggtgggcgactgcagcgcgagcgtcgacgagaaaatacggcttctcgtcagcatcgtgcagaaggccgacgatttgaggctacgaacggtgaggcgagttgtcgacttactgaccacgcaacaggctgttgagttcttgattgccgccgccgaattacagtttggggtccgcaagtggggcctcgatcaggaccgtcgacgtggccgttttgggtaaattaacatcctcgtacccgttttttaaatcttttctcagataaccattgtagtttgttcacttgtttcatcgaatcggtatccgatatttggtattttcagtattcagtagcggtcactggtcatggtctgggacttgtttgattgaaatggatgaattatgtacttattttagaaatcta

SEQ ID NO: 16979 - DNA, 836 bp, Citrus sinensis
  Predicted polypeptide sequence is orthologous to G3083
tttttaccaatgataactttttagtttatatatttatttaagcataacccaactagcaattaaacaagaaattaagcttaaacagtagatttaaaaaaaatacacataaaacattgattaagctagccgcctttgctttataccaagcttgtcggttagctgctggtagtagcaccgtaaagatgcctagcatctctttgtttcccccaatcatgaagcctcaagtgtaactcagccgcagcaatcaggaaatggacggcctgaattggagtcaaaatgtcaataacagctttaaacgttttcagccgtagatcatcagccttgtgaaagatctcctccaactttgcctctttagttacgaaattggactcaatttgatcatccataagcctgcggtcgctatcctgacggtcatcattggtactcatcaactcagtgacaacatgtgataactccaccagggacgaatctgcaaccgtctcttgatactttgccaacttctcagacaagtccttctcttccttaattataacccgttgtaagccatcaactcgggtgagttgagtgggagagaggtcacccaagtcaccagaactcaacccgcgaatcaagtcatggagtttgccttcgagttgtaagccggattttgagtaaagcaagtgaaatgccatgctgggtcgccagccaccaatccaaagaaaagaatcctcaagcgaacttctccatgaaggagtcaacatacccagcacgtctagcttcacccatcttgacttggctcgataatactgctcgtaatgctcaaccacgacacggacttgttcttcaaaattgctgct

SEQ ID NO: 16980 - DNA, 840 bp, Citrus sinensis
  Predicted polypeptide sequence is orthologous to G3086
ttttcagtgtttttggaaaagaaaaataatcagataaataacagcaaaaacagcttacataaataacagcttgtttcttgtttttgactcagacagggagttgagcttttgggtgaagaaaaagcaaattctttcttgactctttcgtgtccttgtgaagaagaagctgtttttgaagttagagaaaagcttagacgtaaagaattgaagataaagaatcaatatcagaactttggagttatatttattgagaaaattaatctttgaggattcttcgggaaacatgagtcttttgtacactcctaatttcaaatatccagagggagacttgaggaagaatcaagaattcatggattcaagtgcccattatgatcaacagaacgaccagctgagtgattctagtttaacgcgatatcgctctgcaccaagctcatttcttgagagtcttgtcaacggtaatagtggcggtggtaattgcgaggattatcgatgttttcgaccttcaagtcctgaaatagacaattttcttgcaaaatatatgttaccatgtaatggttctggtgattctggttctcatgcttcacaagaatttggggtaaaagctatgaagcaagaagagccagaacctattactgaacagaatgagtattctaatggctcctcacagatggtgtaccaaaatttgcctgtgcatagtgtgggaaatgatatttcagtgaatgttggtaatgccatggataattcctatggtgttgcgagctctatggccttggaaaattcgatgcaagagaggatggctaccggaaatggttctaatcttactaggcaaaacagctctcc

SEQ ID NO: 16981 - DNA, 907 bp, Citrus sinensis
  Predicted polypeptide sequence is orthologous to G3091
gggggaacatttttctttcatcgtctcagagtctcagccgcctctgcttttgtctactaataatatcaagcactctctctttaaaccctttttctctaactgaacgagatattcagtctgtgagttgttcaagctggcgatcgaaaatcaagaatccactgtccgtgaaatcaagcccaagaatcgcagaataatgggccccgatgaagaggacaacaggtggcctccatggctgaagccattgctaagggagagcttcttcgttcaatgcaagttacatcctgattctcataagagtgaatgcaatatgtattgtttggattgtatgaatggcgctttctgctctctctgcttggactaccataaggaccatcgtgctatttagataagaaggtcctcataccatgatgtgataagggtatctgaaattcagaaggtgcttgacatatctggagtccaaacttatgttataaacagtgccagagttgtgttcttgaatgagaggcctcagcctaggcctggcaagggtgtcacaaacacctgcgaggtttgcgaccgcagtctccttgattccttccgcttctgctctcttggctgcaagattgttggaacatcaaagaattttcaaaagaggaagaaccggctagcaatgggatcagactctgaggattcatacagcagcggcatccacggcaagctgaagaatagggacttcagcagcaacaacaacaacaaaatgcaaagcttctccccctcaacaccccctccaactgctgttagtcaccgaatcagcaagcgaagaaagggaatccctcaccgagctccaatggggggattattgatagaattctagtgtctacttattggcactttagttttatcatcttattatccacccaacttatac

SEQ ID NO: 16982 - DNA, 859 bp, Citrus sinensis
  Predicted polypeptide sequence is orthologous to G3091
gaaaattaagtcttttcttcccagaagaaagtttcatttttctttctttctttccttttttttttccttatttctccattaatcatgatgatgatcaatagcagcaatcgtgatcatcaagaactgctcactgtaagagaattcaagcccaagaaccgaagaatcatgggaggaggagggccggaagaagaagatgaagaaatgagcaataagtggccgccgtggctgaggcctctgctacaaacgagcttcttcgttcaatgcaagctccatgccgatgctcacaaaagtgaatgtaacatgtactgcttggactgtatgaatggtgctctctgctcgctatgtctctcacttcacagagaccacagagcaatccagataaggagatcatcataccacgatgtgatcagggtttcggagattcagaagtacctggatataacaggagttcaaacgtatatcataaacagcgcaagaattgtcttcttgaatgaaagacctcagcccaggcctggtaaaggcgtcacaaatacttgtcttgtttgcgaacgcagcctccttgattccttcactttctgctcccttggctgcaagattgcgggaacatcaaagaatttcaagaaaaggaaaatgtgcaaggaaatggatcaaggatcggatgctgagattagcagcaataacgggagttcaaagagcaggacacacagcttttcgccgtcgacgccgccgccgacggccgtgagtttcaggactgccaagaggagaaagggggttcctcatagagctccaatgggaggtttactcattgaatactagaatagtagttaaaataaaaaataaaataaaataaaaaaaaaaa

SEQ ID NO: 16983 - DNA, 498 bp, Citrus sinensis
  Predicted polypeptide sequence is orthologous to G3094
gattcggccgaggtcttgcccttccagaatcgagttttgaaaacggtctaatgacgcctgactcgattcttgaaccggtcgggccgacccggacatcttctggatccgacggatacggaggggctcttgcatcctgtgatacaataaagattgtgaagaagaagagaagtagcatcacggcatgtcgttcggtgtgttcaccagtacccgagatgtcggttggtttgatgaatagaaggaaaaagactccacaaagggctcctctttactgaatttgtgttggtgcgatgatccatttgctaattgttaatcgcaaggaaggacttaggacggtaaggcattggggaaattatgaggttgttttattattattattttgaaaagggcaattaggggataaaatgtatatctccaaaattttgtgaatgacaaaactcattatgagcaacaactaaacgaggccctcttatttatgatttaaaaaaaaaaaaaaaaaaa

SEQ ID NO: 16984 - DNA, 863 bp, Citrus sinensis
  Predicted polypeptide sequence is orthologous to G3967
ttaaaaaccaaatgatatctttcaaagcaattgatctggttattaccatccataaatctcacttggaaaaataaattataatcacaaacctcaaatgactgctgtaggttattttatttcatatagatattgtacaacctaattccttggcagcgatatcaagaaactgaatcggcattcctgttgcaagtcggctatgggcttcccaagttaagcatttttcgatgtcagattgccagttaattgcatcaatattgaagtagtgtaacgaagacccatggatgccatttctctctacttgctcaatatttgatttgaacgaactggtatgtaaaaagtcacgaagaactgaagtgctcagtgcacggacatgggcacttggatgagaaaggcatcggatcgttgcaggtagacgacactttaaaaggtttgaaagaccatctgcaattgctaatccagactttccccaccgcaggatgggctgaattgctctagctgttgcttccagtaactcaagttgtggcagtgtgcaagcttcaccatcaacaagcatcccgtctgtggcacgtagaagcaggtctgatgcgcttgccaatattaccagtgactctggactgtcataaattctcatcagctccacaataagttttacaatccgctggttgattctccacatcttctgaccctgatcatcatctttggctatccaaggttgcaattccctttccgcctgaagaacaacagctgtagccgctttcgtgggtgatgccgagacaacattgcacagtgcgtcaaccacctgtcgccacccttgttgggcagaagtgctttcaacactcggttgggtttctggggctgcaatc

SEQ ID NO: 16985 - DNA, 834 bp, Citrus sinensis
  Predicted polypeptide sequence is orthologous to G3967
cagatatattgcttgctgccccccttgggatcagaagtgactacttccggtggtgtagtggtgttatgggaaaatatgcagctggtgagctcaagccacctacaatagcatcttctcgtggatctggaaagcatcctcagctcatgctatcaactccaaggtgggctgttgcaaatggtgctggtgttatattaagtgtttgtgacgacgaacttgctcgctatgagactgctactttaacagctgctgctgtcccggcactcctgcttcctcctgcaacaacagcattggatgagcatctagttgccgggcttccagcacttgagccatatgcacgcttatttcatagatattatgcgttcgcaactccaagtgccacccagagactacttcttggacttctagaagcgccaccatcatgggctccggatgcacttgatgctgcggtgcagcttgtagaacttcttcgggctgctgaggagtatgcaactggtataaaacttcctcggaactggatgcatttgcattttttgcgtgcaatcggggttgcaatgtccatgcgagcgggtatagctgctgatgctgctgcagctttactttttcgcatactatcacagcctgcattgctatttcccccattaaggcaagttgatggagttgaagttcaacatgaacctttgggtggttacatttcatgctataggaagcagatagaggtgcctgcagctgaagcaactattgaagccactgctcaaggaattgcatcggtgctttgtgctcatggccctgaggtggaatggagaatctgtacaatatgggaagcagcttatggcc

SEQ ID NO: 16986 - DNA, 709 bp, Picea glauca
  misc_feature (579)..(581): n is a, c, g, or t
  misc_feature (615)..(619): n is a, c, g, or t
  misc_feature (647)..(647): n is a, c, g, or t
  misc_feature (649)..(651): n is a, c, g, or t
  misc_feature (675)..(675): n is a, c, g, or t
  misc_feature (687)..(688): n is a, c, g, or t
  misc_feature (704)..(708): n is a, c, g, or t
  Predicted polypeptide sequence is orthologous to G481, G482, G485, G1364, G2345
tatgtccatgctaatcaagtttgaaacaaatccattaatcgaaatagatagacgtgaatatttttgtacgaaactttacaaaaataactccatgtcattgcctacaatgacaacaattcacatatacagcaatataaaaatcacaacttcaatgtacaatatcacaactgcctttcattgcatcaagttaaaagctttgcccaataacacaaaattaagttaaatgaatggttcttcgattgatccttcacaaaactagccattaaatttgattggctacatactaatcagcaattcatgacctctcatgcatcattacagatcattgccctgcattgtcaccatatgatgctgcatctgagactgcatatttggaatcccttgatgtacatttgactctttctttccgtattggtctactccagattttgaagatcccttattgtcaccctccgcctctctgtacatgagcaagtaaaccttcaagggctcgatataatcttcaaaccctagcgtgctcattgcccagagcaagtcgtcaccgttgattgttttcctcttctctcgctggcatttgtnnntggcctcgctggtgatgaagctgataaactccgnnnnncattcctgcacggtttccttggcgtctntnnngatcttgccgttggccggcagcgncttcttcatganncggctaatgttggcgnnnnnc

SEQ ID NO: 16987 - DNA, 854 bp, Picea glauca
  misc_feature (39)..(45): n is a, c, g, or t
  misc_feature (762)..(768): n is a, c, g, or t
  misc_feature (773)..(773): n is a, c, g, or t
  misc_feature (795)..(797): n is a, c, g, or t
  misc_feature (813)..(814): n is a, c, g, or t
  misc_feature (818)..(818): n is a, c, g, or t
  misc_feature (821)..(822): n is a, c, g, or t
  misc_feature (826)..(827): n is a, c, g, or t
  misc_feature (829)..(837): n is a, c, g, or t
  Predicted polypeptide sequence is orthologous to G481, G482, G485, G1364, G2345
acctactgaatacagacatttgtgaaacaacatttcctnnnnnnnttctcagcacagttagtaacaacaacccacccacccatttttccagtcttctgagcttgagagacttctttagcactttaaagccccctcctgagcttgagagatttctttagcatgcaagagcttgacccattccagtcaaaaactggtaaggctgcaaagctaagaatcggttgggttggtgatgccattctgcttaactaaggcgcctgttgtccccacataagcaataaaaattaaataaaaacataaaagaaaagtaagtatttctaccattggcccctgggggcttgctgctgctgctgctgcccactgctatttcccccactgctatttggggcggccatattgtaagccccaatcatgtggccgtggtgaccatagaccattccacctggtggttgcccatacgctgcctgctgctgcatatgtggcagagactgagactgtaccctattatagctactagggttcataccactgtaagcattagcattagagttttcaattgaggagccattaatggaagtgttaccttccttggaaggaatctggtctccttgtttggccatggagaccttctcgccctccatttctctgtatttgtggagatagatcttgagcggctcaacatagtcctcaaaccctagggtcgtcatcgcccacagcagatcgtcgccgttgatcgtctttctcttctcccgctggcacttgtcnnnnnnntcgcnggtgatgaaactgatgaactcnnngacgcactcctgtacnntctnctnngcgnncnnnnnnnnnttaccgttggcgggcag

SEQ ID NO: 16988 - DNA, 882 bp, Picea glauca
  misc_feature (2)..(2): n is a, c, g, or t
  misc_feature (4)..(12): n is a, c, g, or t
  misc_feature (22)..(24): n is a, c, g, or t
  misc_feature (32)..(38): n is a, c, g, or t
  misc_feature (40)..(42): n is a, c, g, or t
  misc_feature (68)..(71): n is a, c, g, or t
  misc_feature (845)..(847): n is a, c, g, or t
  Predicted polypeptide sequence is orthologous to G481, G482, G485, G1364, G2345
gntnnnnnnnnnaaggaacagnnncgattccnnnnnnntnnnaatgtgagcagaatcatgaaaaaagnnnntccagccaatgccaagatatcgaaagatgccaaggagacggtccaggaatgcgtttcagagttcataagtttcatcactggggaagcttctgacaagtgtcagagggagaagaggaagaccatcaatggggacgacctgctgtgggcaatggggactctagggtttgaaaactatgtggagcccctcaaggtctacctgcagaagtacagagaattggaaggtgaaaagacatcaatggccaaacagagtggtgatcagtcaccttccaaggatgcctctagtggcagtactgttaatgggtctagtgcaggcaatcccagtattagccctggaagctctgctaaatatagcgggggctactatccacaggcctatgggggccaagctgcacagatgtatggacagcatcagatgctaactccttatcagatgcatatcaacactggtaaagctggtggtgcaggagctgctaacagtggagatcatcatcctagagggcagtggtagaagtagaagagtggacactgattttcctgtttactgtatagtgagtggttgttgcagagttctggatgtgtatggggatggaattatgaaaagaaaagttttgctttcgttttctctgcttcttcgcctctgtaaacagagtacatgggcttctcatgggagcttcatgggcatttagcataaattgaggtgaggctgtatatttctgtcaactttaaaatttcaaaatcctgtatagcgcaatttagcttcctgtggttttttannnaagtagttgctctcctatgaaatgggtacaactca

SEQ ID NO: 16989 - DNA, 905 bp, Picea glauca
  misc_feature (763)..(769): n is a, c, g, or t
  misc_feature (862)..(869): n is a, c, g, or t
  misc_feature (874)..(874): n is a, c, g, or t
  misc_feature (876)..(886): n is a, c, g, or t
  misc_feature (897)..(897): n is a, c, g, or t
  Predicted polypeptide sequence is orthologous to G481, G482, G485, G1364, G2345
gttttgcaggtttctcacctgcggcgcgcgtttggttcgttggatgacaaaaacacattctaattgtatttattcatctcccctccaagagagcagcggcagccatggcagacttagcgagctccgtcaccagccaagaaagtcctcactcagaagacacgaacaataacagccacaaccagggttccaatgcccgggaacaggatcgattcctccccattgcgaacataagccgaattatgaagaaggcggttcctgcgaacgccaagatcgcaaaggacgccaaggacaccgtccaagaatgcgtctccgaattcatcagtttcattaccagcgaggcgagcgacaagtgccagcgtgagaagcggaagacaattaatggagaggacctgttatgggccatgggtaccttagggtttgaagattacgtggagcctctcaagctttacttgcataaatatagagagatggagggtgacagcaaaggagctgctgctagcaaatctggtatgggggatcccactaagaaagatttgagtaattttggagcagtagcaaatattaggtgaataaattctgttcaacaaaaccagggattgaaccatattcaacaggtcagattttgctgcaagtggtcatttgaaaatgtgtatgcgttacgatgcttggaagggtgaaattgtgggcttggaagctcctagtaataaaagacatgtttaattttttgaaataataaaaaatttgtgattaatcattgacatcnnnnnnntttgctgagtaatctatgtgatccttgtacataagagaaaatcctaagtttgatatgaaagatgtttttttatggcagtatatttatatgacnnnnnnnnggctngnnnnnnnnnnntcttgttatanttatttta

SEQ ID NO: 16990 - DNA, 932 bp, Picea glauca
  misc_feature (855)..(855): n is a, c, g, or t
  misc_feature (858)..(867): n is a, c, g, or t
  misc_feature (869)..(874): n is a, c, g, or t
  misc_feature (877)..(879): n is a, c, g, or t
  misc_feature (893)..(893): n is a, c, g, or t
  misc_feature (895)..(895): n is a, c, g, or t
  misc_feature (906)..(913): n is a, c, g, or t
  misc_feature (915)..(915): n is a, c, g, or t
  misc_feature (925)..(929): n is a, c, g, or t
  Predicted polypeptide sequence is orthologous to G4
agaaagtaaaatcctcttcgaaggatgtctgcagatcagatgtgccaatctacggctacgatgatatggaatatggggacttggagttctcaaaacccggtgccccatttcaaagcaattcaaatgcatccacagttcaatcttctgagcatagcaatttaagtcaaactttgcagaaatcgtgctcttgtgagatctgtagttacaactattcagaggtcagcaatttaatgcccactgcttatggcgatgccgtaaattttgaacaagtgaaatcttcccaaccagcaggttattttgattctgatcatagcagcatgtcatttgaaggggcgcatttcccatgggcttatgatacgaaaaccccagaaatttcgtctgtatgtgaggatgcaaatgagtctacctttgtggacattaaaccccaggtagatgatgttgttaaagacggaactgtggatacccctattgaggtcgatggtgggacaggtggattctacaaaacagaggataacaacgttgaacttgagttttctgatttggagtcatatcttggtttgacagaggatccgaatcttaatgcaactgtgaatcaatcaatagaagatgcgggtcatgctgtgggctcttttccagatgtgcagggttccatggaatcatggctctatgacgatctgcccatttcaggtttagtttttcaaaacagtcttagttcttgcttcttataaatacataacaagcaagcagactcgtgatttgaattttgatgttgcaggcctatgtataggtcttttggactcatattttgcactttctgtttatgttttataatttgtttttctattaattaagccnctnnnnnnnnnngnnnnnnggnnngtaggattcgtatntngtaaaattgtnnnnnnnncntttgggtacnnnnnccc

SEQ ID NO: 16991 - DNA, 846 bp, Picea glauca
  misc_feature (770)..(773): n is a, c, g, or t
  misc_feature (785)..(786): n is a, c, g, or t
  misc_feature (796)..(797): n is a, c, g, or t
  misc_feature (800)..(802): n is a, c, g, or t
  misc_feature (816)..(817): n is a, c, g, or t
  misc_feature (830)..(831): n is a, c, g, or t
  misc_feature (836)..(842): n is a, c, g, or t
  Predicted polypeptide sequence is orthologous to G4
ggagcccataatttcatattgagtaatcagtattttctttagcaggtcgttgtttcgtgtcctgcgtagtcagcagcagcttttttgaaagcaaaacgatgtgtggaggtgccattatttcggatttcattcccgccaaccgatctcggcgaataactgccagggatttatggccggatttcgatacgttcgctgagttgttcatcaatggcggagccgtgtcggaatctttcaataaatcaggcagctttgatgagggtttcgtcgacttcgacgagggatacaagcagaagattaagcccagcaagaatattttcaactccaagcagaaattttcttcaggtgatgaaaacgaggcgattcctcctttgaaggatttcgaaaagtccgcagccaagagcgcggggaggaagaggacgaatttgtatagaggtatcagacagcgtccatggggaaaatgggctgcggagattcgagatcccagaaagggcgttagggtttggcttggaacgtttaacacggcggaagaggccgccaaggcgtatgatgcagaggctaaaaagatcagaggcaaaaaagccaagcttaactttgctgatgactcgtgttctgtaaaaatagaccgtagcaaaagaatgtcaaagaagaaagtaaagttatgtacaaaaaacccagatttattattgagttttaatataaacagcaaggtaaaatcttcaaattcaccaaagcctgatttattagagggttattatataaacactcaaatnnnnccttctttgaannatgtctgcanntcnnntcttccaatctatnnctacaatgatatnnagtannnnnnntctc

SEQ ID NO: 16992 - DNA, 734 bp, Picea glauca
  misc_feature (588)..(589): n is a, c, g, or t
  misc_feature (627)..(628): n is a, c, g, or t
  misc_feature (633)..(634): n is a, c, g, or t
  misc_feature (667)..(667): n is a, c, g, or t
  misc_feature (671)..(671): n is a, c, g, or t
  misc_feature (675)..(676): n is a, c, g, or t
  misc_feature (680)..(681): n is a, c, g, or t
  misc_feature (686)..(687): n is a, c, g, or t
  misc_feature (693)..(693): n is a, c, g, or t
  misc_feature (695)..(701): n is a, c, g, or t
  misc_feature (718)..(720): n is a, c, g, or t
  misc_feature (726)..(726): n is a, c, g, or t
  misc_feature (728)..(730): n is a, c, g, or t
  Predicted polypeptide sequence is orthologous to G5, G974
gcgaaactcaatgtaaacataataataagaacataattccatgtttgtttataaaggctccgtgttttgcggcccacatactcagtggctttctaacacgttatagtaaccacatgctttctaacattttatagatatattttcagaatccagcacatcccaagtcagatccatgtccaacgaaggcattccgatcacaggatccactcttcaacatcagtccacgttgtagccagagccgaagccgaagctgagattgatggcatattgcagactgcatctgtcatagatttacaaggtagcgcagaatcagaattctgtgctgcaaacactggattgttatcacccccactgaattcaggacattctgatttcacctcaaagggtgatttctccttacaaggtgtcacttcactgatcttttgattcaaagagttatggcccaactttccttcatgggatggtttagtggatgcagatgaacgttcacagattgcttgcagtttggcatcgactgcagattgcaaaacagataacagtccagattgatttctaatgtctgtaattgaatgcagattggaagtagannatggggataaactatgactaccatgattcaattgctgnngctgnnttaagcccggaaaattcaagcgagcatactcanctcntagnntgtnngcagnnctgtcntnnnnnnntgctgcctgctctgctnnntcaaangnnncaag

SEQ ID NO: 16993 - DNA, 878 bp, Picea glauca
  misc_feature (40)..(45): n is a, c, g, or t
  misc_feature (782)..(784): n is a, c, g, or t
  misc_feature (802)..(806): n is a, c, g, or t
  misc_feature (808)..(808): n is a, c, g, or t
  misc_feature (818)..(823): n is a, c, g, or t
  misc_feature (828)..(829): n is a, c, g, or t
  misc_feature (832)..(833): n is a, c, g, or t
  misc_feature (836)..(836): n is a, c, g, or t
  misc_feature (854)..(854): n is a, c, g, or t
  misc_feature (859)..(863): n is a, c, g, or t
  misc_feature (877)..(877): n is a, c, g, or t
  Predicted polypeptide sequence is orthologous to G5, G974
gatgtcatttgttcatctatctgaaccacagttcatgatnnnnnnaattgcaatactgaatgctaactttacactattacaaacaactattaatatcatcccagttaatgtccagagaaggaatactgagcaaataatcgtcaagctctgcccatatcgacgaggccgagaaggatggcatgctacacaaagtatccgtttctgtatctgcctgtgtctccgacttggaggccgaaggagattcggattcaccagctgaattcaatgctgtaatggtggaatcatcactactatcagactcacaagtctcagacttgacagacacaacatcattcttcttcgcatcctcatcctgcaccgacccaagagagcctgaattctcatatgcacatgaaatttcttctgattcttcagtcttagacattttttccatgggtagtttcaagctctggcaaattgcttgcagcttggcatcaacagccgatggcaacacagaattcccagtccagggggcgaaggaattcgcttccagatggcgtttgaggtgaggaaagttgagcctcgcatagtcaccccttagcctgtaagcagccttgtcataagccatggccgcttcctctgcggtatcaaaggtgccaagccatagcctcgttctgtctctgggtaacctgatctctgcaacccatttaccccagtggcgctgcctcacgcctctgtaaagcttagccgcctttgacaggccgctgctatgcagtttcatgggctgagctctgggacccagnnngttccgacccatttggtnnnnngnagccgctgcnnnnnngatgnngtnncantgaagctgctgctgtagntgctnnnnntgctgtacatgtanc

SEQ ID NO: 16994 - DNA, 743 bp, Picea glauca
  misc_feature (677)..(682): n is a, c, g, or t
  misc_feature (698)..(700): n is a, c, g, or t
  misc_feature (720)..(726): n is a, c, g, or t
  misc_feature (729)..(734): n is a, c, g, or t
  misc_feature (736)..(740): n is a, c, g, or t
  misc_feature (742)..(742): n is a, c, g, or t
  Predicted polypeptide sequence is orthologous to G12
agggtgtagaagtcaatctgtgcattccttgcatttcattgtgatttaattcagttctgtttttattgttgctagggtttacaagtcagtttctgaatttccttccgttcaattgtagttgatattttggaaaggatgtcggaaaagaatcacgaacaccaccatctcttccaccatcagaaggaagatgagaaccagaacgccgccgccgcctcataggcgacgccgtacgagaaggcgatgaaggaggagaagcatcataagcgaatggaccactttggagaactgggaacagtcgctgctggaacgtttgcactggtactgtatatatatctcttattctttaattctaattttactagtgacgaggtcaattgatttttatggatagaaggtattaatggtttccttaaatctgaattcccttgattgctggtgagtctataaactagatcatcgaagtactaattaggtcattcggtatgccgtaggagaaacatcaagcaaagaaggatccagagaacgcgcacagacacaagatcgcggaggagattgcagcagcagctgcagtgggagcggggggctacgtcttccacgagcatcacgaaaagaaggaatctaaaaaggaagtaaaggatcaccatttctagccgcccactgtcagtcccgatgcattnnnnnnaattttctttcgctgnnnaattactgtcatctgggacnnnnnnnagnnnnnntnnnnncnt

SEQ ID NO: 16995 - DNA, 908 bp, Picea glauca
  misc_feature (813)..(815): n is a, c, g, or t
  misc_feature (823)..(823): n is a, c, g, or t
  misc_feature (837)..(845): n is a, c, g, or t
  misc_feature (856)..(856): n is a, c, g, or t
  misc_feature (875)..(875): n is a, c, g, or t
  misc_feature (879)..(879): n is a, c, g, or t
  misc_feature (881)..(881): n is a, c, g, or t
  misc_feature (884)..(897): n is a, c, g, or t
  misc_feature (902)..(904): n is a, c, g, or t
  Predicted polypeptide sequence is orthologous to G38
gttccctcatctcaatctaccggaattgacgctgtttctgaagctggagttgaggtgaggaatggtggtagaattgcagataccgatcaaagatatgggtcagaaatatgctcaggtgttgaggctgctaaatcagattttccttccaaagttgagataagtgctgccttaccagattctactgtagatcttcctgtgaagttagacacaaaggaatgtacattgatccctagactcgtacctaaagatgaaccacaagatgcagatgggcgaaatacttttgatttgtcccagaccacattgcttagatttagagatgagtcacagtcagagttgccatctgcagccgtctcaatagcattatcaaaccctgaggtgcagccaatttctataaaagctgaacaaaatgaatctgccgagcctctcgactcttttcaagatatccaattgcaggatcttgatgaaatgtttgatccagatgagctcttgaaaatgatgaatgggaacgagaacaaaggtgaattatcggaagcggatacccaaatgttaagttcactttattacagctcttggccacaggaagagttgaccgatggggacgtcttaccgagttgtgatccttcttctagccctactctgcaatacttgcagtttcagagcccggattataggatgctccaagatcctgttgtggacgaaggtgaacaacttcacctagatgatagaaacttcaaaggccttggtcaattacaacaatttaatttagatagctttcaacaatccgagtatcaggctgtcaaacaacatgtcagnnntgatgatngacagcctctgcannnnnnnnntctggatgatngtcattttgcctccttccnatancnatnnnnnnnnnnnnnntaccnnnctga

SEQ ID NO: 16996 - DNA, 832 bp, Picea glauca
  misc_feature (43)..(51): n is a, c, g, or t
  misc_feature (773)..(773): n is a, c, g, or t
  misc_feature (787)..(788): n is a, c, g, or t
  misc_feature (803)..(805): n is a, c, g, or t
  misc_feature (808)..(811): n is a, c, g, or t
  misc_feature (814)..(815): n is a, c, g, or t
  misc_feature (819)..(830): n is a, c, g, or t
  Predicted polypeptide sequence is orthologous to G129, G136, G140, G146
aggatagatcgtcttactccttaattatacaaataataaagtnnnnnnnnnccatgttttgaagttataatgtgccacacacggaacacatttacaatgcaatatatattacatctcaacgttagaactaagtgagtgagtacttagatcaaatccacaaggaacatgttggttaggtaataaagttgtaaatccatgtgttagaagtgaggtaattcccttgccatttgtacattcgtccaactttccttgaagcatcatgttgctcatccttaacgtatgctccttattttgaagggttttaatctcctcaagcatgagttcattcttttttgatcgtacttgatttattcctttttgtagacaacattctaattgatttagctcctcaaatgtcacagaaccaagcccttctcccatcaaatatctgttgctgttgttgttgctggtgccgagctcgtacagctttcctcggctggagaaaacaatgagagctacctctgcatcgcacagcactgaaagctcgtaggctttcttcatcagaccgcctcgccgcttgcagaaggtcacctgcctatgcacgctattctcgattttcttgatctctattttaccgcgccccattttcacaacgacagcaaaatcccaagagtttccgaaatctgagtatatgcaggcgttaaacttaaagatgttttatgaacaggataactgagcttccttccactagtttggactagcttcagggtttactaggttttgcagaatagtcnagctctcattaatnncttcctgctacgatnnnagnnnntgnngcannnnnnnnnnnnag

SEQ ID NO: 16997 - DNA, 875 bp, Picea glauca
  misc_feature (765)..(766): n is a, c, g, or t
  misc_feature (806)..(813): n is a, c, g, or t
  misc_feature (822)..(829): n is a, c, g, or t
  misc_feature (844)..(844): n is a, c, g, or t
  misc_feature (849)..(852): n is a, c, g, or t
  misc_feature (866)..(866): n is a, c, g, or t
  misc_feature (868)..(871): n is a, c, g, or t
  misc_feature (874)..(874): n is a, c, g, or t
  Predicted polypeptide sequence is orthologous to G137, G145
atgaacaagaccttggaaagatacgaaaaatgttcatatgcaatgcaagatactacaggcgtctcggaccgagaagcacagaattggcaccaagaagttacaaagctgaagggtaaggttgagctccttcagcgatcacagaggcatttgttgggggaagatcttggtccactaaatgttaaggagctacaacaacttgaacgtcaactcgaagttgctctggcacatcttaggtcaagaaaaacgcaggtgatgctggaccagattgaggagcttcgccaaagggaacggttgctacatgaagtaaacaagtctctgcagaaaaagctttccgaaacatagggaagagatgtaataactggcatagagcagacttctaatactaatactggtactaacgggccttgggattcttctatcacaaacaccgcatatgctctctcacaccctcaacaaaactcaaatgcaagcctccaccatgtggactgtgaacccacactgcagattggatatcagcctgtgcctcctgaaagcatcggccctcctcatcagcctcagcacaaccaaacgcagaatcaatacatgcaagggtggtgggtttgatatttaaggatttatcattatgatttacacttcaatcactacataagccaaaacatggcaaattccgaaactatgattatattatcataaaaggaaacctcttctcagtgtatagcagtacgcttgattttactggtatgatatcttaagaagagttgattnngcaaacaaacccttctggtatattggaccttgttatcgannnnnnnnaattgcatnnnnnnnntatactaatctggcnactannnngagcttcggaaaantnnnngtnc

SEQ ID NO: 16998 - DNA, 600 bp, Picea glauca
  Predicted polypeptide sequence is orthologous to G148
ttttttttttttttttttctgaagtggggattgtttgattttgatacataaacttgagcagaatatactcatctgagtacacagttggaatctcttgctatatctccaagagaactgaaccactaacaagaagggtcaaagcatagacagcaaacaagtgttacagcaggctggtctcttggaagaataatttccacaggagtacacactttgtccctgtaacttctcgaaaccatatacaaccgacgcatttctaccatatagttccattgtacctaacatattgtaattaccttatacaaagctgggagattggatgatgcattgaaacctttataaagaacatgatctcgatcttacagcacctacatatgtgttgctagtctttgcgaggatgacagagtaatggtagttgtagaattgtttaggaaatcattgaagaaaggttatgatctcaagatcttactcgatgacaacatttcctgtttgctagaaatgatgggagagattacatatcaattcagttgacaacagtaatagcaagttcttgagatgttcattaataaagccatccattatctatgaaaaatcgaatttctg

SEQ ID NO: 16999 - DNA, 503 bp, Picea glauca
  misc_feature (465)..(465): n is a, c, g, or t
  misc_feature (485)..(493): n is a, c, g, or t
  Predicted polypeptide sequence is orthologous to G154, G627, G1011, G1797, G1798
gcaagatactcagtatttaaaacaggatattgcaaatatggaagaaaaaattaagattcttgaatcaagacaaagaaagatgttgggcgaggaactggcatcatgcgcattgagggatttaaaccaattggagagccaggttgaacgaggattgagacatatacgagcacgaaagactgaaatattggtggatcaaatagaacaacttaaaagaaaggaacggatattaactgaagagaatgctttcctcagtaaaaggtttgtcgatcctctctatgagaatggttccgttttgacaactgctgcaaatggattaggaagcatccaaaatagtgaagtcgagactcaacttgttataagacagccgagatcattttcttgttaatacttctcattgatattcactgatgataataaatctattatatattattaataaaaggtaaaggcacctcattgttcagnaacttaaaaaaactgtcatnnnnnnnnnatggacgttt

SEQ ID NO: 17000 - DNA, 808 bp, Picea glauca
  misc_feature (767)..(773): n is a, c, g, or t
  misc_feature (782)..(787): n is a, c, g, or t
  misc_feature (789)..(799): n is a, c, g, or t
  misc_feature (801)..(803): n is a, c, g, or t
  misc_feature (806)..(807): n is a, c, g, or t
  Predicted polypeptide sequence is orthologous to G154, G627, G1011, G1797, G1798
agacgggggggtgtttctgtaatttctatttttttggtttttatgtttttggattctcagcttcagcttatgagtcgaggagccgcttgggttctttttggaagccattacagggtttaaattttttcgccttccattttctggtggtgattgttgtgattccctgattcgagagtctgattcattgcttcgagggcattagggagggcaagagagaggagaggagtctggagaatggggaggggaaagacccagatgaagaagattgagaacgtgaccagcaggcaggttacgttttctaagcgaaggaatggtttgctgaagaaagcttacgagctctcagtgctctgcgatgcggaagtgggacttattgtcttctcaccacgcgggaagatttatgaattttccagtcgctgtatgcaaaagatgttggagagatatcaaacatattcacaagaaagtgacataagtaatgctaccaaagagcaagatactcaggaacggatcttaactgaggagaatgtttttcttagtaaaaagtgtgttgatcaatatgctgatagttcggttctgaaaacacctaaaattcaagttggaagtatccaggacattgatgtggagacccaactgttaataagacctccaattgtacaaggtcacccttatctggatagttttcattgatattttttcattccatttcaataatttatataataaatttgttattattacatatatgttaatttttttatattttcattatnnnnnnnaacattatnnnnnnannnnnnnnnnnannnaanna

SEQ ID NO: 17001 - DNA, 798 bp, Picea glauca
  misc_feature (11)..(16): n is a, c, g, or t
  misc_feature (52)..(59): n is a, c, g, or t
  misc_feature (773)..(781): n is a, c, g, or t
  misc_feature (789)..(790): n is a, c, g, or t
  misc_feature (792)..(792): n is a, c, g, or t
  Predicted polypeptide sequence is orthologous to G154, G627, G1011, G1797, G1798
attaaaaattnnnnnnatcaaatttcaacctttatccaagttgtgttgatannnnnnnntcaaaaatacttagaaagacactgcagttgtaatgtctgtataatgaaaaaatgagaagcttgcagtcgtactgtctgtataatgaaaatatgagaagcttacatatgcattagtaacaattttattatataagctatcgataggaaggggatcttatacatttggaggtctcataaccagttgagtctccacttcaatgcgctggatgtttccaagctggagtacaggtgatgtcaaaaccggaccatccacgtattcagcacacttccttttaagttgttctatttcatccaccaatactttagtcttttgtgctcgtatgtggttcaaccctcgttcagcttggctttctagatgatttaattctttcactgaacatgatgctagatcttcccccatcatctttctttgtgttgattcgaggatcctaattctctcttccatatttgcaatttctcgttttaaatgctgattatcttgttctttggtagtgttatctatgtcactttcttgtgaatacttttgatacctctccaacattttttgcatactgggattggcgaattcatagagcttccctcggggggcgaaaacaataagtgccacttcagcatcgcagagcaccgacagctcgtaagctttcttcagtagaccgttcctgcgcttagaaaacgtaacctgcctgctggtcgagttctcgatcctcttcatcnnnnnnnnncccctcannantctcgt

SEQ ID NO: 17002 - DNA, 873 bp, Picea glauca
  Predicted polypeptide sequence is orthologous to G154, G627, G1011, G1797, G1798
cagtagcactcattatcgggtcttaattgtaccccctgtccttcgacactggcgattgttctcattgcctgatctgatcaaactgaggctctgtgattgattgttttgagggcaaaagagaggagaggagaatggtgaggggaaagacccagatgaagaggatcgagaacaccactagtaggcaggttacgttttctaagcgcaggaacgggctgctgaagaaagcttacgagctgtcggtgctgtgcgatgccgaagtgggacttattgttttctccccgagagggaagctctatgaattcggtagtcccagcatgcagaaaatattggaaagatatcaaaaacattcggaagaaaatagtataaataagatattcaaagaagaaaatactcagtctttaaaacgggaaattgcaaatatggaagaaaccattaggattcttgaatcatcacaaagaaagatgttgggggagggtctggcatcttgttcattgaaggaattaagtaatttggaaagccaagctgaacgaggattgagccatattcggtcacgaaagactgaaatattaaggaatcaaatcgaacaacttaaaaaaaaaggagcgtattttaagtgaggagaatgcttttctccataaaaagtgtgttgattcccgatatatggatggttcggtttcgggaagccctacaattggatttggaggcgtagaacaggtgacgaatcggtgactttaacatcatggagtgccttaacaacacattatgtcaccgactgtcctacacctcggagacgcatgcaaggctatagatattttctgctggttgcatacatttttatcttattgtttacatctctaattaaaatgagtatca

SEQ ID NO: 17003 - DNA, 883 bp, Picea glauca
  misc_feature (792)..(797): n is a, c, g, or t
  misc_feature (827)..(827): n is a, c, g, or t
  misc_feature (829)..(835): n is a, c, g, or t
  misc_feature (860)..(864): n is a, c, g, or t
  misc_feature (869)..(881): n is a, c, g, or t
  Predicted polypeptide sequence is orthologous to G154, G627, G1011, G1797, G1798
gacccagatgaagagaatcgagaacgctaccagcaggcaggttacgctttctaagcgccggaatggactgctgaagagaccttacgagctctcggtgctctgtgatgccgaagtgggacttattgttttctcccccagtgggaagctctatgagttcgccagttccagcatgcaaaaaatgatggaaaagtatgaaacctgttcacaagaaagtgatataagtgaatcaaacaaaaagcaagatcctcagtctttaaaactagaaattgaaaatatggaagaaagaattaggattcttcaatcaacacaaagaaagatgttgggagagtgtttggcatcatgttcaatgagggaattaaacgacttggagagacaagttgaacgaggattgagccgtattcgagcaacaaagactaaaattttattggatcaaatagagcaacttaaaaggaagttagatgacattcaagtcaaaaatggttatagttcaacaccttcagttggattgggaaggatacaacacatggaagtccagactcagctagttatcagacctcctgatgtacaaggtcatctgtaaatgtgaattcgaaattgcattggatttgatgagtagttagaggatatttgaaatattttggtttcattttagtttcctagtttagttgatcttgggaatatctttccaggttatgtaaacagtttgataactgccacagggaggttttaccctgtggagaaacttataaatacttattatttttgtaataatatcatcctcattcgtgggcnnnnnnggatatggaattttaatacagactgagacnannnnnnntattctgctacagctttagcttttnnnnntatcnnnnnnnnnnnnntg

SEQ ID NO: 17004 - DNA, 636 bp, Picea glauca
  Predicted polypeptide sequence is orthologous to G156
ttttttttttttttttttctcaaaaaatttaaatattttataaaaaacattaggcaaagatccaatcaattgcgaatattctggggggaatgaaaacattgcagaaaatgggaaatttttcttttccagaggatctcgcttctttccacacaataaacagtctaacccattttcgaccctttatgatctccattactgttctggctttcaaaaaaatagacaaacagacagttcctgcccaacagtacaggaggaactgtaaggaatacatacttggaactggaatattcagagagctttcccgagccagaaaatacaacaagcccaacgctggcatcgcacagtattgccaactcccgggctttcttgaacaggccgcgtttcctcttggtcaatgtcacctgcctcctcgtcgtgttctctattttcttcatctctcgcttccctcgccccatgattatactcaaaaatcgctaccccgtctgtaaaatgggaatcagttcacatatacggaaaaactaggtttcaggaaccttaagacagttcacgggatcgaccccgggcagacaatcctcgacaaaatttcacactccggcaaattcagctcgctatcccggcgagttgctggaatgaaac

SEQ ID NO: 17005 - DNA, 944 bp, Picea glauca
  Predicted polypeptide sequence is orthologous to G175, G877
tttttttttttttgaaaaactgaagactagtttgaagtataatttacatagaaatcatttatgaatacaggacctgcgaaatatttagcagtacacaacctataacatatttcttaagattttacatctacaagacttaaaaatctgttcagggccacatatttcatggctttcaaggataaatgcttttcttattttcagatatgtagaatgatcacaaatactttgtgatactctgcataaaacacattttcatgttcaaaaaaaattaccgtattctcaagcaagctggcgtgactaaacaagaattcacaatcaaggtcccatagatagtctccccatgatttgttgatacagcgttgagtttgtgggattgaaaggtaattggttcccaaaaccagaatcatcgttttgttcttcttttggcctcagaaatctcatgccattatctttagcttgaccaaaatatggctgaatgggaacgataggctttccactaagttcgatgccaggcaatccatggtttgtagtgccatgaatctgcattggaaatggtggatgcccttctgcaatttgccttttatcagtgtgactattacctaaaccaaacatcccaaaacccatccctgcacccattttcaggtcaagactccctgcattcttatcttgcaaacgtaggttcccatctacaaccttttcaaaatatgctcgtttcccatattcattcctaggatccaaatgtctatcaaaccgggaaacaatgccttgaacttggggaacaggccgagaaacaatgtcttgaacttggggaacagatcgtggtatagtattcataggcgctgggccattagtctgcatagctagaggagcagccccattcccttttgcagcattgtcatggctgctgtttcgggcagcaggtacatcatggttatgctttcctt

SEQ ID NO: 17006 - DNA, 526 bp, Picea glauca
  Predicted polypeptide sequence is orthologous to G189
gttgatgcttttattgctctcccagagggtactacaagtgcaacagcataaggggttgcccagcaagaaagcatgtggaacgttctttggatgatccatccatgctgattgtgacatatgaaggagaacacaaccattctcagtccatgtctgaaagcacaggattggtggtggatccatgaggctttttgcagattgattcatgtgaaggcacaaaagattttaatccatggccattgtttgtgtgcaatgggccactttctatggaatgccttgaagaacctttatagggaagcagccagctgatatcgatgctaaactttttttcatggcctctaatgaggttgttttggcaaagctgatctcgtttgcataatgtgataaaaagagatctttgtggagtactgtggaggactatttcactgcccaagatatttaaattttggtttacatgatgtacagactatgagactcttaatcgaatagaagacatgaaagagttctctaatggggaaaatttatattg

SEQ ID NO: 17007 - DNA, 820 bp, Picea glauca
  misc_feature (31)..(36): n is a, c, g, or t
  misc_feature (710)..(712): n is a, c, g, or t
  misc_feature (746)..(750): n is a, c, g, or t
  misc_feature (754)..(759): n is a, c, g, or t
  misc_feature (762)..(766): n is a, c, g, or t
  misc_feature (808)..(810): n is a, c, g, or t
  misc_feature (814)..(817): n is a, c, g, or t
  Predicted polypeptide sequence is orthologous to G196
tttctctctcttccatttatttgattttctnnnnnnttgagaaacccaatatcctttgggcatactcagacccccacaaacaaaaacctttggacatgggcttgaaaacatgactgtaaaatgatgttttttaattgatatttgaccaatctggaattctcaggcatttgatctgaattctctttctcggatgtattcactttctctgcttgcctggtagatcctgccagcacgttcctgtgagtcatccaagggtgattgtggtcagatgtataagtgatcactagcatgttcgaatccgtttggctcctttctacacgtttcctcattgagaaacctttagagctactgcatctgtagtaccctattacacagtttccaacgataatggagtccccgcaccatccatacgcaagcacgctgctaaaaaattgaaagtgcatcatagattcatggggttgagagagagagcctttgattggattttgaccatatttacgccatgcccacatatctgaaggaaggcattcatcgctaggtctgttgctccctcctgctgcaggaaatcaaactattctcttgcggcttcctccttttggatccctggcccttagctgagcccatcatctgcgaactactcccattctccagggccaaatccgtcctgacctgatcgacaaagacaaatcgtcgccgtttttgttgacgtnnnctcgaccttgaggggtttcgagtccggctcgggnnnnngcgnnnnnnaannnnntgggctcacagcttccttgattttcaatactgttaacttgcnnnattnnnnctc

SEQ ID NO: 17008 - DNA, 903 bp, Picea glauca
  misc_feature (765)..(765): n is a, c, g, or t
  misc_feature (848)..(851): n is a, c, g, or t
  misc_feature (870)..(870): n is a, c, g, or t
  misc_feature (872)..(874): n is a, c, g, or t
  misc_feature (878)..(883): n is a, c, g, or t
  misc_feature (886)..(891): n is a, c, g, or t
  misc_feature (898)..(902): n is a, c, g, or t
  Predicted polypeptide sequence is orthologous to G197, G255, G664
cttgcagctaagttgcttcattctcctgtgttgaagatggggagatctccctgctgtgaaaaagctcatacaaacaaaggggcctggaccaaagaagaggacgaccgcctcatcgcccacattcgagcccacggcgaaggttgctggcgctcgcttcccaaggccgcagggctgatgcgatgcgggaagagctgcaggctccgatggataaactacctgcgtcccgatctgaagcggggaaacttctcagaagaagaagacgagctcatcatcaaactccactccctcctcggcaacaagtggtctcttattgcaggcagattgccggggcggacggacaacgagataaagaactactggaatactcacatcaagagaaaattgctaaacaagggactcgacccccagtcccatcgcccccttggccaggtccacagcagcaacactacctgttcctctctgcccgcccctgagcacgaaattctggcgttccagagcccgagaacgccggagatagcagatttctttcaatacgaacgctctgaaagctcgccgatagagccggccgcttctaaagacgaagagtatcccgacttaaatcttgagttgtgtatcagcttgccggttcattcggcccccgccgcaagcagggcttcgagcgtcgatagaaccgtggattcaaaacctaattctggcagcgaactgtgctgtcccatggggctgcaagtaaattatggcgcgcaatgcgagaacagatatagtgangagaatgcttcaggtttctcgagtcattacaggcttgtcttatagaagctttatggtttgcttattaactggtctccgattcnnnnacgaagcattcatatgatnannngccnnnnnnaannnnnntgtttannnnnt

SEQ ID NO: 17009 - DNA, 875 bp, Picea glauca
  misc_feature (12)..(15): n is a, c, g, or t
  misc_feature (768)..(768): n is a, c, g, or t
  misc_feature (781)..(782): n is a, c, g, or t
  misc_feature (805)..(806): n is a, c, g, or t
  misc_feature (841)..(850): n is a, c, g, or t
  misc_feature (857)..(864): n is a, c, g, or t
  misc_feature (869)..(869): n is a, c, g, or t
  misc_feature (874)..(874): n is a, c, g, or t
  Predicted polypeptide sequence is orthologous to G207, G227, G230, G242
gcacgaggagcnnnngcagagcttgtaatactcaccgacataacgcaacagaagaaaaacgttttcaaataagagagagcgagaccgaccgacagagagctctacagatcgatttcgatcctgttgtgagctgaaacaatgggagttcccaaggacgaagcggcggtgacaatggcggtggcggagcggatcaaggggccttggagccccgaggaggacgcaacgctccacaggctggtggagaaatacggaccgcggaactggtctcagataagcagaggaatcccggggcgttcggggaaatcatgcaggctacggtggtgcaaccagctgagcccccaggtagagcaccgccctttcagcccacacgaagacgctaccatcatacaagcccatgctcgacatgggaacaaatgggctacgattgctcgtctcctccccggccgcaccgacaacgcgatcaagaaccactggaactccacactccgacgccgctaccatggtgagaaggaccacagcaacgggctagtagtgaacttggaatcggcggctgaggacaaggaagcgatgatttctctcacggcaccggcaatggtaccggctttagttttcgcagcggctgcggacagcagcagaaaacggagcaatagtagctgcagcgcgaatgacaatccgggagatgccgaggtcgagtctcgtcggcttaagaggcttaatttttctgaatccccgactagttctgataataataataataataatgaagangacactattagtnntcattgcaattcggtcgccccannatcgagtcctgtacagcagctgcatcgtcctgttnnnnnnnnnnctgcttnnnnnnnntatgnagctnt

SEQ ID NO: 17010 - DNA, 638 bp, Picea glauca
  misc_feature (612)..(614): n is a, c, g, or t
  Predicted polypeptide sequence is orthologous to G264
gcggatcaatgatgtgttttgggaacagtttcttactgagagcccacagccaatagacacagaggggactgattcagagagtcaggagagtagtaaggatcaagacgatgttgtgcctgaatatagcaatttctgtaatagaagggagaatcttgatcaacttacactacagatggggcaactggcatcatcagtaaacctttgacatcagactaagcatgagtatttaagtcactgcagcattaacaacaggcgaatataggagggccagtaaagttaattgtttctcaagaacacaagcaggttctaggtgtatcttatgttgctctttttgatgcttctttcaagattctgctagttatatcggttaaatgcttgcgagagatatgataaacagagttctatcaattttttatgcatcactctgtccaaaatgcattgctgcttatttcagcgggtgggttggaatgtaagtaggacttcaggtttgttgatgcgattggccttttcttaaaaccatccactagggatgtgtcttatattgttccactttgaaaaggggcaatcctatctatattagaactttctttacttgttatgcatagtgattannngaaaaaaaaaaaaaaaaaaaaaaa

SEQ ID NO: 17011 - DNA, 412 bp, Picea glauca
  Predicted polypeptide sequence is orthologous to G268
ttttttttttttttttttttggtaaaggtcatgctggaaactcatcaccttgaataaatgggtcacaccttttgcagaaaattacactgatcatatcaaaaatggcacattgggaaataatattacattgaatgacaatcatgaccagtaattcaggaacgcaattgctgcttttgaccaaatagcaccttcctactaacataggctccctcttctgtatcaaacaaaagtactctccatcccattgcctttgcaattggctctatttcaaaaaaaactactctgttatctccaatataagcatatccaccaggacgcaaaattcggtccatctctaacaaaatggctggtatggtacatcttttccgctcagtggaaaataaacccgaagcatgaagaagatcatagcctc

SEQ ID NO: 17012 - DNA, 845 bp, Picea glauca
  misc_feature (754)..(758): n is a, c, g, or t
  misc_feature (780)..(786): n is a, c, g, or t
  misc_feature (793)..(798): n is a, c, g, or t
  misc_feature (802)..(808): n is a, c, g, or t
  misc_feature (817)..(819): n is a, c, g, or t
  Predicted polypeptide sequence is orthologous to G274
atgagataaaataattttattaatgtccaaaaaaagaccaaagtaggtcaaagggctaaaagagtacatctagtgtcgatccaaagtaggagtgccaaggcatctcctaaaacaatgttaaaagaagaaagacaaataaatgaaatgtaatctttttatgatatccatcacattaatgattctagaaccccaaaaatatcactgttctattccaacagcataaaataatgaatctgttagccacatggtgtattcactggtgtacccagacctctcacaagtacaatgggtgtctgctcatctgcatttccagcaggattgtctataaggaccatttccagatactttactcaatcaaatcaactttttcttacttttctattgttttatttttcttgttgctttcgagtttgatcctggtttgtagctgcatctttcctttcatctggtcttttgccctcgaggacagggtcaggttacgacattacgtatatgtttgaacctgtccacgcccattcacattaatttcttcaatggactgcattccacccatgatttccatgtcctatttataagttgttatcgttcagtggctttccgttattgtaagggtccatggcacgctgcatcggctcataagttaggaaggttttctgaacagctatccggcttcaaatttgagatacaagatgaggtcaaaaacaaattcagcagacagcaggaccaggagttctgtttctatctttattgtttnnnnnttatgctgttttttctacgtannnnnnncttggcnnnnnngtgnnnnnnnaaagggtgnnngcattgcattggaaatcaccaagcta

SEQ ID NO: 17013 - DNA, 610 bp, Picea glauca
  Predicted polypeptide sequence is orthologous to G275, G837
ttttttttttttttttttgcaaggagattccagcagatggatgccgtcaaagaagacatctctttccagatctgaacatcttcctccttgctttggtagacaggagtagctgaccacacaaaataaccccctggccttaataagcgatttagctcaagaagaagcttgccaccatcagcatgccatggaaccctgcatcgagcacaatgcacaatatcaaaaacagtactgggaaaaggaagcctttgagtgcccatcacagctgatattgcaggaataccacgttcaagagcaaactgcacttgtgcttcatgctcatccttaggtgcaagggacatggtcaggacctgtctttcaaataggaagcctccaaaactggcaactccacaaccgacatccaataccacacggctccgccttccccatgcaacatctgggatagtctcctcaataaagtctatgtaatgaagagctccatttttgaattgagttccacctccagggaaagtaatatgttctccggacaccctcacccaattttgacgttttttatactccgcaagcttggtgtgtgggacattgttgtaccatatcttatctctgctctctg

SEQ ID NO: 17014 - DNA, 887 bp, Picea glauca
  misc_feature (738)..(738): n is a, c, g, or t
  misc_feature (740)..(740): n is a, c, g, or t
  misc_feature (834)..(840): n is a, c, g, or t
  misc_feature (843)..(845): n is a, c, g, or t
  misc_feature (856)..(858): n is a, c, g, or t
  misc_feature (862)..(862): n is a, c, g, or t
  misc_feature (864)..(868): n is a, c, g, or t
  misc_feature (874)..(886): n is a, c, g, or t
  Predicted polypeptide sequence is orthologous to G275, G837
tgcttgcaaagagtgccacatgaggatgatgaacgtggaactgagtggccagaggagtggccttcaaggcttgaaaaagttccttactggttaaagaaggatgtgcatgatcattacatatcagatacagagcattggaaaaggattgttagcaagtcataccttccggggatgggaattgattggtctgctgttcggaatgttatggacatgaaagcagtttatggaggatttgcagcagctctagcatcacagtcagtttgggttatgaatgttgtgccaattgatgctccaaacacgcttccaattatctatgagcgtggtctatttggtatatatcatgactggtgtgagtcgtttaatacttaccccagaacatatgatcttttgcatgctgatcacttgttctctaagttgaataaaaggtgcagcttagttcctgtaatggcggaggttgatcgcattttaaggccagggggttcaatcatcttccgtgatagggtggagacactgaatgaattggaaaacatgataaagtcactacagtggcaaatccgaatgacatattctcaagatcaggaagggatcctatgtgcacagaagaccatgtggcggccacagcaagtagcttgaatgcttttattcaatttatctggcagcaacattcaagtgtacaaatggttcaagtcagtgcggaacctgctccactgtatgttagagcctgaatttcttccagangnccaagttgttttttgattctttaattgtattgccagaatctgttcacctttactagattttattagctgtctatatattcctccctatcccctnnnnnnnaannnaatttatgtannnacanannnnnttaatnnnnnnnnnnnnnt

SEQ ID NO: 17015 - DNA, 886 bp, Picea glauca
  misc_feature (14)..(17): n is a, c, g, or t
  misc_feature (801)..(801): n is a, c, g, or t
  misc_feature (803)..(803): n is a, c, g, or t
  misc_feature (808)..(810): n is a, c, g, or t
  misc_feature (815)..(815): n is a, c, g, or t
  misc_feature (853)..(853): n is a, c, g, or t
  misc_feature (878)..(880): n is a, c, g, or t
  Predicted polypeptide sequence is orthologous to G307, G308, G309
cttcaatctcaagnnnngaatccaatggccggccttgatacaggccctggcgcttcgtcccggcgggccaccgtctttcaggctaactggaatcggcccgccacagcccgacggaaccgatgccttacaggaggtcggcatgaagctcgcccaactggcagagtccatcaatgttaaattttccttccgtggttgcgttgccaaaagcctctccgacatcaagccatggatgcttaacgcccggcccgatgtcgaggccgttgcagtcaattcgatccttgagctccatcgtcttctcgacgacacgatactcggacaacccagcgccatcgaccgagtcctcgcgtcaatccgggccctaaatcccaagatcgtgaccgtggttgagcaagaggccgaccacaaccgccccgttttcttggaacgattcacagaggcactgcactactattccacggtttttgactccttggaggcgcgcggcctgcaggccacgagcgaagagcaggtgatgtctgaagtctatctgggtcgagagatttgcaacattgtagcctgcgagggatcggaacgagtcgaaaggcacgagcctctcttgaattggagcgttcgcttgcggaacgctggcttctggcctatgcatttgggatccaatgctttcaagcaggccagcatgctgctaagtctattctcgggtggggaaggatatagggtcgaggagaataatgggtgcctaacacttggttggcacagcaggcctctaattgcagcttcggcctggcaatgctatctcacaccgtnangaagnnnatagntgtcactgaaacgatcaaatatactagcaattattgtngcagcatcatcgtttcatcgaaccnnnaacagc

SEQ ID NO: 17016 - DNA, 780 bp, Picea glauca
  misc_feature (676)..(676): n is a, c, g, or t
  misc_feature (681)..(682): n is a, c, g, or t
  misc_feature (684)..(689): n is a, c, g, or t
  misc_feature (691)..(695): n is a, c, g, or t
  misc_feature (744)..(746): n is a, c, g, or t
  misc_feature (748)..(748): n is a, c, g, or t
  misc_feature (755)..(757): n is a, c, g, or t
  misc_feature (762)..(762): n is a, c, g, or t
  misc_feature (767)..(767): n is a, c, g, or t
  misc_feature (776)..(778): n is a, c, g, or t
  Predicted polypeptide sequence is orthologous to G312
attctatggaacccaccaacatgtcaagggattgtgcagaacggcttaacgtggagaagcttttctttgcagagaaaataatggggattgtagcatttgagggagccgaaagaaaaacgagactggaaggaagagatcagtggcgtattctcatggaatcagcgggattcaaattcactaatctaagtcattatgcaaagagccaagctcgaattcttctgtataattactgtgaggggtattcactacaagaatcctcgggtttcctctctttggcatggcaaactcggcctctcctcactgtctcagcctggtgctgttgctagtctctgagaatctggcaatcccttgtacagtgccaattgattattcactatacatagaacatttgctgcatctaggatggaaatcaaattatgctgtgtgtacatacatacacattgtgactgtaaataaagggtctctatatcatcatcatgtgaatatgtctgtaatttttctcctccctctttgcttcagtaaattttagttctagcgcatgtcatgcatccctttggcaaattttttttagttgggtagaccaattatttcttgtaggcagcagacaacggtgggatgattgacctctaccattgccaggggtgcatgacaactctgtaaccctggattaaatcangggcnnannnnnngnnnnnattgagagaaagcctctcgtctcattcttctttgttcaacacctttcgnnncntcctagnnnctctncaatnatatatgcnnngc

SEQ ID NO: 17017 - DNA, 871 bp, Picea glauca
  misc_feature (4)..(10): n is a, c, g, or t
  misc_feature (47)..(55): n is a, c, g, or t
  misc_feature (788)..(789): n is a, c, g, or t
  misc_feature (823)..(824): n is a, c, g, or t
  misc_feature (841)..(844): n is a, c, g, or t
  misc_feature (859)..(868): n is a, c, g, or t
  Predicted polypeptide sequence is orthologous to G312
tatnnnnnnngaaaattctggttacataaggggtttcagggaccttnnnnnnnnnagagactttcctttttaggtaatggaggctttgcaacacttgctctgcatatataattgaagagaaactaggaagaaccgaaaggtgttgaacaaagaagaatgagacgagaggctttctctcaatcccttcttttcctaagcccttgatttaatccagggttacagagttgtcatgcacccctggcaatggtagaggtcaatcatcccaccgttgtctgctgcctacaagaaataattggtctacccaactaaaaaaaatttgccaaagggatgcatgacatgcgctagaactaaaatttactgaagcaaagagggaggagaaaaattacagacatattcacatgatgatgatatagagaccctttatttacagtcacaatgtgtatgtatgtacacacagcataatttgatttccatcctagatgcagcaaatgttctatgtatagtgaataatcaattggcactgtacaagggattgccagattctcagagactagcaacagcaccaggctgagacagtgaggagaggccgagtttgccatgccaaagagaggaaacccgaggattcttgtagtgaatacccctcacagtaattatacagaagaattcgagcttggctctttgcataatgacttagattagtgaatttgaatcccgctgattccatgagaatacgccactgatctcttccttccagtctcgtttttctttcggctccctcaaatgctacnntccccattattttctctgcaaagaaaagcttctnnacgttaagccgttctgnnnnatcccttgacatgtnnnnnnnnnncat

SEQ ID NO: 17018 - DNA, 823 bp, Picea glauca
  misc_feature (62)..(67): n is a, c, g, or t
  misc_feature (741)..(743): n is a, c, g, or t
  misc_feature (759)..(764): n is a, c, g, or t
  misc_feature (774)..(778): n is a, c, g, or t
  misc_feature (780)..(780): n is a, c, g, or t
  misc_feature (782)..(782): n is a, c, g, or t
  misc_feature (784)..(785): n is a, c, g, or t
  misc_feature (787)..(791): n is a, c, g, or t
  misc_feature (793)..(793): n is a, c, g, or t
  misc_feature (797)..(797): n is a, c, g, or t
  misc_feature (804)..(804): n is a, c, g, or t
  Predicted polypeptide sequence is orthologous to G324
agtatcttaagagcacacaagtgcacaaaatggcataaatttacattctactcgtaaaattnnnnnnaaatgaaaaactgggacttgcaagggaagaatttaaatatcaagaagccaaacttccgtgtaatggatgctaataatacataaatcctaaaaatttacaccggaatcaataccttcttccacctgctgtagacagaagaaccttgctagctttcttgccctttttcccagaactttgagacttggatacctgcctactacattcttgcccgctgggttttggggctgttataatatctgcaaatgacatagtggacgaactgcttgtaccaccatctgcagaaacacccgctctttccatattaatgctatttgaagcggaagccattgaacccggggacaactctccagataggccttctttaagagctggagaatcatacccagcagcaagtccaagtcgtgtaacatgtgaaaaaagcttccgctcattcaatactggagaactcacagatgcactctttggttccccttcaaaatcggcacttgacggtggcttgtcatcagtactgacataagtaaactctggtagaacaggtcttgcttggactgtcacagctgaatccaccctcttagctctagcttcctgctttcgacgacgacgacgttcagcattgcgtttctcgatctcatcagtaaatggaaaaaatgcactagcaggtaaaaggtcacttnnntcaatctcacacaacnnnnnngttgtagtcnnnnngnantnncnnnnntngcgnaagcgtnttctgatgacttctgactg

SEQ ID NO: 17019 - DNA, 919 bp, Picea glauca
  misc_feature (794)..(804): n is a, c, g, or t
  misc_feature (827)..(832): n is a, c, g, or t
  misc_feature (879)..(884): n is a, c, g, or t
  misc_feature (898)..(902): n is a, c, g, or t
  misc_feature (908)..(915): n is a, c, g, or t
  Predicted polypeptide sequence is orthologous to G324
cttttttttgctctggataatttagtatttgagtttaatacaaaaagtacatgtttttttagccatgggaattggtaactcattagagtgacctagactaggcccaagatcaaattaactagctgccaatataatccaagagtatatctaatggtccgcaagccagatatactaataacttatgacttagcaagggtcgagacgtcccaaggcacccgaaaggcctctatcccaggaggcatttacccttctatcctgatcacaacgtgccaagtctcattgggaatttgaacctccccaccacttgagatattgccccttgactataatacagagtacatgttaatcaattcacagccaaggattaggggttacatgcatctatgcttcaataatctttcatcggaacattgcccaatggcaaaaacacaaggcctgccacatgttccccaatggcaaaaacacaaggcctgccacatgttcaatgtagttcaacggagaaaaccagcgttcttttaactccaaaagaaaaatatagtatccctttgaatgaaattttttcctactagaatcctttgcaatgaccaattatagagagttttcattcccatattcttcttgcctccaagatggatgcttttacaccaagcaaatccaactcattgccttgcctggtccctaaccaataaatttttggatgtctagagaaggatgaatagattacggtaaacgcaaagacaggcaacgcaattattttgagattgtgatgactgacgctgatgctaagcatccannnnnnnnnnntctcttataacttctcatactcnnnnnnttattgataagctcatagccttagccttcttaatcaaaaattgcatnnnnnnagccatgtgaaaannnnntgctgnnnnnnnncata

SEQ ID NO: 17020 - DNA, 809 bp, Picea glauca
  Predicted polypeptide sequence is orthologous to G328, G2436, G2443
ttttttttttttttttttagactggcattagatttattcattaacagagaagattgcaggaagctgaataagtaaacttccatcgacttgaaatcttaaactctggaaaagactaatagtatgtatggctgttcttataagtgtgagtcacacccacttcatctgactgcagtctgacccacatcaatgagcaaggcagaatcagtaagaaagaggcattgaatttgagatcaacccaaatgtgaatagacgtgcctcatactaaccccatctcacaggcatcgataaattgaagatacaaggcattatgattataatggcagttacaattagaataacaaggatacttactaagaagaattatttctattgactggatcaataagatggaacaactccgtatccctgatcaggcagtaaagaagatgagtatatctgctccacttctacctctgttctcttggcaaatcggccttttatacggggccgagtctctgcataggcttttctagacgcatatcgtattgtcttctcaaaccttctgttctttcttttttccctatatctgagaacccttgcttctcttcccatgacctcaacatggcctccaggatgaacaacccgaggcggaatctcgaatactcctctggggtcatggtaaggagttgaaatgtcagttgtagtgttgctgtcaggtacaatcccaacatctatggaagaggaagagacacagtggttgagagatgtagttctgtaaacataattgcacttggatgctgcatccacatccaatgacctagctgtttcaa

SEQ ID NO: 17021 - DNA, 715 bp, Picea glauca
  misc_feature (97)..(98): n is a, c, g, or t
  misc_feature (163)..(165): n is a, c, g, or t
  misc_feature (682)..(687): n is a, c, g, or t
  Predicted polypeptide sequence is orthologous to G328, G2436, G2443
ggcacgagggaaacagctaggtcattggatgtggatgcagcatccaagtgcaattatgtttacagaactacatctctcaaccactgtaggagtattnnagattccgcctcgggttgttcatcctggaggccatgttgaggtcatgggaagagaagcaagggtnnncagatatagggaaaaaagaaagaacagaaggtttgagaagacaatacgatatgcgtctagaaaagcctatgcagagactcggccccgtataaaaggccgatttgccaagagaacagaggtagaagtggagcagatatactcatcttctttactgcctgatcagggatacggagttgttccatcttattgatccagtcaatagaaataattcttcttagtaagtatccttgttattctaattgtaactgccattataatcataatgccttgtatcttcaatttatcgatgcctgtgagatagggttagtatgaggcacgcctattcacatttgggttgatctcaaattcaatgcctctttcttactgattctgccttgctcattgatgtgggtcagactgcagtcagatgaagtgggtgtgactcacacttataagaacagccatacatactattagtcttttccagagtttaagatttcaagtcgatggaagtttacttattcagcttcctgcaatnnnnnntgttaatgaataaatcttttcccagtca

SEQ ID NO: 17022 - DNA, 868 bp, Picea glauca
  misc_feature (788)..(790): n is a, c, g, or t
  misc_feature (830)..(834): n is a, c, g, or t
  misc_feature (840)..(844): n is a, c, g, or t
  misc_feature (852)..(860): n is a, c, g, or t
  Predicted polypeptide sequence is orthologous to G347
caacgcagtcactgcagttccgcctcctgggacagaaatggctcagctaatctgcggacattgtcgtacattgttaatgtatgtccgtggagcaactagtgttcagtgctcctgttgcaccacagttaatcttgcaatggaagcaaatcaggttgcacatgtgaattgtgggaattgttttacaacacttgtgtacccatatggagctccatctgtaaaatgtgcagtctgtcattacgttacgagtgttggacaaataagcaatatgagaatgccacttcctgcacaaagacctccagcagcagctacaacagccccagcttctagttcagcacttccaacacgatcacaaactcaaactgtggttgttgagaatccaatgacagtagatgaaagggggaaaatggtgagtaatgttgctgttggagttactacagagaagttatgataaaaaaaaatgtactgccgatacttttttgttcatgtccttgggattgctgcagaattcctacgcatttgtgggaagatgcctctgatttccgaagaatttgtaccatttgatgccctattctgttgtaggctcgagcaagctatcagtaggaagacaatagtcttgactcaagtctgcttttgtggtcattactatatggacaactgttagggatacttgttcagcactggacatcttgtgcattagtagtctgtatctttttatccatcagtaaatgggactttaaggatattaaccggaaagataaccgagtatcaagctttgagtgagtaaattnnntcaatactacacaccatgaaaactttctattattactttnnnnnatttannnnnactcatannnnnnnnnttgcattc

SEQ ID NO: 17023 - DNA, 462 bp, Picea glauca
  Predicted polypeptide sequence is orthologous to G363
ttttttttttttttttttttaaacattttaacctcttatctgctttatgtatttcaacaaaagcttgcatacccatatctgctgcatgccgtcgtttgctaggattaaagataaaccccaacattgttaaattcacagatatatcgctaatccaaaatgacccggagttttaacccttttatatcaatcaacccccatgaagggaagccttattccacaaccaaaacccagcgattcaaacgacgatttgtaatgcaaaaaattaataatgtttctgtaaggctagcacaagatcacaccaatgtggtatgcatgcgtgcaaatccacttatttcttacatggctaaacaatcccacaaggaatatgaggtcatctctggagtcacccactgtacccgttcccaataccaaacagaaaacaaaccctaaccctataaaccaatcccatctgcaggaaaatgt

SEQ ID NO: 17024 - DNA, 305 bp, Picea glauca
  Predicted polypeptide sequence is orthologous to G370, G1995, G2838
ttttttttttttttttttttgggctggaaacagaacccttttaatattgcccgaaatccgggagcgagggataaacatttcttggatttgcgacaaacatcaatgaacccaaattccccccccgattaacggttctggattgcaaaaaaccctttaaaggttgccgaaaaacttataaaaatttcccccgaaggcaaagcattggggggcaccccggggctttccctccggaaagcttggggcggccccggggttattttaccggaaaaacccctaagcataagccctataaaaggggtccccct

SEQ ID NO: 17025 - DNA, 895 bp, Picea glauca
  misc_feature (819)..(829): n is a, c, g, or t
  misc_feature (840)..(843): n is a, c, g, or t
  misc_feature (846)..(850): n is a, c, g, or t
  misc_feature (873)..(875): n is a, c, g, or t
  misc_feature (880)..(882): n is a, c, g, or t
  misc_feature (892)..(892): n is a, c, g, or t
  misc_feature (894)..(894): n is a, c, g, or t
  Predicted polypeptide sequence is orthologous to G375
tgctgctgctgctcaacggtcacgggttccaccccagccgcctccatcatttcttttgtttttttgcgctgcaaatttggtgttgtgggcggtgtttatatgcgattgtaaggctggtagtggttggtcataatttgcagtagtgaggctgtggagaagtaggcgattttagagtacttggtttacagaacaatgatgctcagccctgttcaagtctgcatggattccactgattggccacagggcatgatgcaggagagagggtttaggccaagtggcgaagacctgctttcatgttcacgtccattgcttgagagaaggctgaaacctcagcctgaacaagccctgaaatgcccaagatgtgattccaccaacaccaagttctgctactacaacaactacagtctatcacaacctcgtcatttctgcaagacctgcagaaggtactggaccaaaggagggactctgaggactgtacctgttggtgggggttgcagaaagaacaagagggccaagagaactgtagctgcagaacagcccatgtttagcacacaaagtgaaccatccacctcagctacaccctctgcaagtgccctgccaattgccttggaccatcaaactgaccttaatcctgctactaattcaagctcttatttcaatcttcctgcaaatagtactaccggcccaactgaagctaatctagcatttgccagaatccaacaagctgcaaggcatgggggtcggtctgttctacccaactgcaacaactctgattttttgggcctctcctgtggcagcactacccaatcctcctttggnnnnnnnnnnngtctaaatagnnnnaannnnntatcatcactgaccaatctttcnnnactgnnngctctgaatncnt

SEQ ID NO: 17026 - DNA, 861 bp, Picea glauca
  misc_feature (775)..(775): n is a, c, g, or t
  misc_feature (777)..(779): n is a, c, g, or t
  misc_feature (792)..(794): n is a, c, g, or t
  misc_feature (807)..(807): n is a, c, g, or t
  misc_feature (809)..(809): n is a, c, g, or t
  misc_feature (811)..(811): n is a, c, g, or t
  misc_feature (816)..(817): n is a, c, g, or t
  misc_feature (822)..(823): n is a, c, g, or t
  misc_feature (851)..(851): n is a, c, g, or t
  misc_feature (853)..(860): n is a, c, g, or t
  Predicted polypeptide sequence is orthologous to G386, G707
caactctgcagcgccagtgtcaaagagttgcctttctgatgtcgacaaacgctccgacgggagatcttgcagctgttccgacacccagcggacgcagaagccttatgaaacttgctgaacgtatgacaaataagttttgtagtggagtgagtgcatcgagtaggcatacgtggaccaagttatctcagggcagtggagacgatgatgtccgagtaatgtcgagaaagaacgtggacgatcctggagagcctccgggagtagttctgagtgcagcaacatctctatggctgcctgtttctccaaatcgattatttgacttcttgagagaccagagatatagaagcgagtgggatatactgtccaatggaagcccaatagaagaagtaacccacatatccaacggaaaagatcgtgggaacagggtttctgttcttagtgccaaaaactctaatcagagcaacacattaatcttgcaagagagctgtgcagactcgtatggatcgatggtggtttatgctccagtggaaatttcagccattcatcaagttatgaacggaaatgactcaattaatgttgctctccttccttctggttttgtcattcttccagagggaccgccggaaagccgatctctagttgacaatcaaccagtcgaaggatcgctgttgaccattgcatttcagatactagttaacgatctcccaacggcaaagctgacgttggagtctgttgagactgtcaataatctcatttcatgcactgcacagagaatcanannngctctgcagaaannngatgtttgatgtncngngatcnntcgcnngctaacttactatctcttcaattatttntnnnnnnnna

SEQ ID NO: 17027 - DNA, 727 bp, Picea glauca
  misc_feature (2)..(7): n is a, c, g, or t
  misc_feature (10)..(14): n is a, c, g, or t
  misc_feature (651)..(653): n is a, c, g, or t
  misc_feature (709)..(709): n is a, c, g, or t
  misc_feature (717)..(719): n is a, c, g, or t
  Predicted polypeptide sequence is orthologous to G386, G707
tnnnnnngannnnntgcaattaagctaaataatatcaatgccgtcatgtcatcatgtacatgaatggatgattgagtttagctgaaagatgagagtaccaaacgatttaagattttgcggggagtcaatacccgaaccactacccttgcatggtggtaaagcttatgcaaatatcatttgtttgtttgataattgcattgagaaggaaagaagctttagtttctgtctgtctggttttggtttcatttaccacttggcaaggatatatgtggtgcgttcttgactccacgacgcatccttcatgaatattttcagttacatatatcatgtaatcccagtaatcccattgccgtccatccgaggacaaaggtgaaagcaggcagaaggaagtggctgtggctgttgctgtgagggacaaatcaacacccagctcaatgcgagcaaattggtgttgagatcccctcataactgcccagttccaaaccccccttacctagcacgttaaacattgattggcatggactaaacaaaaacaaaaaagctgatggggacacaaaaaaactagacagcgaggattaagagggacatttatgtcaagcatcttcacagtgcagagctgccttgattttctgcacagtacaggatatgagnnnattcaccgtttccactgactccacagtgagtttggctgttggcaagctgttgactnatatttgnnntgcaactg

SEQ ID NO: 17028 - DNA, 899 bp, Picea glauca
  Predicted polypeptide sequence is orthologous to G390, G391, G438
ttttttttttttttttttatgacattatgtctcgctgagaatctttaaatataacaaaatgcaacaacaaagtgctgcttacaaaatccatccaagttgtctataggtataagagttctgacagtattagccaaacaagctgaataaaatatgtgataatttagccgactacttaatttccacaaaaatgagtattcatctactcttctgcatgaacaaaatggtcacataaaggaccaattcataaacatgaaaacgatgcagtgggtactgtcttcgtcgttcagaaccttccaagctattgcccggtcatatgaagcaggcctgcccatacttgagagacatatcccagcaggtagataagcataaccctgttggataatttgaccataatctgtaaaaaaacttttgcgcccattttcgtcaagaattttgtccaaagagatatcttgcaatgcaaccaatgttgtttccagcatgtccaaccctgcttgatttgcaaatgtaaaaacaggcaatgacttcacagaacagcacatgattgcatctgaatggtgccaaagtagtttcagtacagactcgctggcttcacaatcagctcgaaacaggtctacccctatgtggagtctgtagctctgacaaatccaacgggcaagagtaagtgcttctggagtcccaggaggtggccttgggccaacatgtgcactcagtcgggaaggagctaatgccatggcaaccctctggacagatgctacaacactacggacatattgacgagccatagctgccacattttctcgcaagtggctctcataagtgaactggaatgcaatagtcaacacagatctcagattcgagttggcgccagaatcaccagacgttctagtgccagctgatcc

SEQ ID NO: 17029 - DNA, 907 bp, Picea glauca
  misc_feature (848)..(854): n is a, c, g, or t
  misc_feature (869)..(871): n is a, c, g, or t
  misc_feature (882)..(882): n is a, c, g, or t
  misc_feature (890)..(896): n is a, c, g, or t
  misc_feature (900)..(902): n is a, c, g, or t
  Predicted polypeptide sequence is orthologous to G390, G391, G438
caatgatgctataaacagttttccttaagatggctggttttcagttgctagcgatgggatagatgatatcagtatttcacttaattcatcttggagtcctagaacagttggtcttaagtgtagttcctccaacaacttgtggtctgatggtgatgggggtgttttatgtgccaaggcttcaatgcttttgcagaatgttcctcctgcagtattgatacgtttccttagagagcatcggtcggagtgggcagattgggcagattgtgaacatgacgtgagctgttcggccactttgcgaactcgtgtatatggtgctgcagctttaggtggagctgaacttggcagacgagaagtacctatgcctccagcccattctgaacatcaagagataatggagttagtgaagtttgaaggttatgactctgctcgagatggtgccttagtgtcaaaggagatgtacttactccagctttgcaatggcatcgacgagacagctattggtgattgtgcacaactagtttttgctcctgttgacggtgccctttctgatgatataccattgttgccatctggctttcgtgtcataccactagatactgattttatggatggatatggtatgtcttgcacccttgatttagcttccatgcttgaaggtggttcagatatggatgcggctaagactgaaactggaatttcgtctaacaatttacgctctattgtcactatagcatttcaatttggttatgagacacataactgtgatagtgtgtcagttgctgcccgcaagtacatgcgtactgttgttgcttctgttcaacgtgttgcaatggctattgctcccagannnnnnncaacactgggtttannnaatctttctgntaccagtnnnnnnntgannnttgtc

SEQ ID NO: 17030 - DNA, 854 bp, Picea glauca
  misc_feature (730)..(733): n is a, c, g, or t
  misc_feature (761)..(767): n is a, c, g, or t
  misc_feature (779)..(780): n is a, c, g, or t
  misc_feature (797)..(797): n is a, c, g, or t
  misc_feature (801)..(801): n is a, c, g, or t
  misc_feature (816)..(821): n is a, c, g, or t
  misc_feature (828)..(828): n is a, c, g, or t
  misc_feature (841)..(841): n is a, c, g, or t
  misc_feature (847)..(853): n is a, c, g, or t
  Predicted polypeptide sequence is orthologous to G390, G391, G438
cttgtgctgaacttgtctttgctcctattgatgcatctttagctgatagttctcctttgctcccttctggtttcagagtcattcccttagattctggaatggatggctctagtccaaaccgtacattggaccttgcgtctgccctcgaaattggatcagcaggaactcgaacatctgttgattatggtggcaactccagcaacctcagatcagtattgactattgcttttcagttcacttttgagaaccatttacgggagaatgttgcatccatggctcgtcaatatgtgcgtggtgttgtagcatccgtgcagagggttgccatggccctagccccttctcgactgggttcccatcttgggccgaggctacctcctggcaccccagaagcactaacccttgcacgttgggtttgtcagagttacagattccacttgggtgtagagcttcttaggcctaattctgaggtcaatgaatctgtgctgaaaacactttggcaccactctgatgccatcatgtgttgctccttgaagtcattgcctattttcacctttgcgaatcaggcaggccttgacatgctagaaacaaccctggttgccttgcaagatatttcattagaaaagatacttgacgacaatggccgcaaaagcttttgctcagatattgctcaaatcatgcaacagggatatgcctatctacctgctggagtatgtgtttctagcatgggcannnntgcttcctatgacagggctattgcttgnnnnnnnctcaatgatgannaaaatccccattgcatngcantcatgtttatgaatnnnnnntttgttngaccattattttncagtgnnnnnnnt

SEQ ID NO: 17031 - DNA, 906 bp, Picea glauca
  misc_feature (786)..(786): n is a, c, g, or t
  misc_feature (788)..(790): n is a, c, g, or t
  misc_feature (827)..(830): n is a, c, g, or t
  misc_feature (839)..(844): n is a, c, g, or t
  misc_feature (846)..(851): n is a, c, g, or t
  misc_feature (864)..(865): n is a, c, g, or t
  misc_feature (868)..(873): n is a, c, g, or t
  misc_feature (880)..(887): n is a, c, g, or t
  Predicted polypeptide sequence is orthologous to G390, G391, G438
actcgagcaagtggtgattgtggagacagcccatacaatctgagatctgtattgactattgctttccaattcacttatcagaaccatgtacgagacagtgtagcggccatggcccgccagtacgtacgtcatgtcatagcatctgtgcagagggttgccattgcactagctccttctctacagagtcctcatccacctcctggtaccccagaagcacttacgcttgctcgttggatttgtgagagctacaggatgcatctaggactagagcttattgaatctagttctgaaaccaatgaatccgtgttgaaactcctgtggcaccattcagatggaatcatgtgttgctcctggaagacattgccagttttcacatttgcgaatcaggcagggcttgatatgctggagacaaccttggttgccctgcaagatatatcactggaaaaaatacttgatgagaatggtcgcaagaggctgtgttcagattttacacaaattatgcagcagggctatgcttatctgcctgctggaatatgcatttctagtatgggcaggcctgtttcatatgatcgagctatagcgtggaaggtacttaatgatgaagacgttactcattgcatatctttcatgttcgtgaattggtcttttgtgtgaccagttttgggatgtaaattcaatagaaaagccatgttgggatcttatcatccaaacaaatgggtttactgctttttgaagcttctgtaactttaagttttatgccagctggacagaacaaccctactaaangnnnttaaaggctctaatggatcatgtaagcagcatcttgnnnntgcattctnnnnnntnnnnnnacagatgcttagnnatnnnnnnctatcannnnnnnntatttcttaagcattttga

SEQ ID NO: 17032 - DNA, 328 bp, Picea glauca
  Predicted polypeptide sequence is orthologous to G394
ttttttttttttttttttataattacaaaacaccatcaaaattactagaatagagaaattacatgcccaaatagagaaattacaggcccagccatgagagtggttcagatccaatgcgagcgaattgaacaaaagagagacaagtaaaatgctccgcacaaaggtggattgcccattctgctttaattgcaaagattcaactggaattattcacgcgaagccttgagaaaatggaggtgtctgatgaactgatttatgtacaggtcctgggatagaatcccgcggtcactgtggctgccgagaatttgattcttgaacaggtttcccc

SEQ ID NO: 17033 - DNA, 768 bp, Picea glauca
  misc_feature (33)..(38): n is a, c, g, or t
  misc_feature (44)..(53): n is a, c, g, or t
  misc_feature (702)..(706): n is a, c, g, or t
  misc_feature (719)..(719): n is a, c, g, or t
  misc_feature (738)..(740): n is a, c, g, or t
  misc_feature (742)..(742): n is a, c, g, or t
  misc_feature (746)..(747): n is a, c, g, or t
  misc_feature (759)..(759): n is a, c, g, or t
  misc_feature (763)..(763): n is a, c, g, or t
  Predicted polypeptide sequence is orthologous to G394
catgcctccctgtgtattatcgatttcgtcaannnnnnttttannnnnnnnnnaacaaacccacagaaatataacaagggaaaaaggtctgtaaaaatacgaccagatccgtccgtatgagctataacaatttttctcctaactttcatccatgattcccacccataaccatatgcacatacttaacactaacacacacgcagctcgctctctctatctgtctgtattcttcgatcccgcgacgtcagagtgcgcggattaatttactgtagtttacaatcaaggcagctcctcaataaataaacctcgaggggccctgagttgattacagaacaccgatatacaattaattaacaggccgccgaagaatgcgtataaggatagaactgcggtttcgccaaagtgaaaggcggcggcctgctgttctccgccggaacaaccctttcacaggaggggcacatggtcagagttgccgctggcatttgcatatacagcggagacgccaatttcagagctctcaattcctgcaattctttctgcaatcttctgttctcgtctgttagtgattcgcagcatcttttcaaaaactcgcagtccacttcagtttgcttcagctttgtccttgctcttctattctggaaccagacttcaacttgccgagggcggagattcagccgtttggccagggcttgcttttgcttnnnnntgagggagctgtnctctttgaagctttcctcnnnangagnngattgctccttngacnatctg

SEQ ID NO: 17034 - DNA, 930 bp, Picea glauca
  Predicted polypeptide sequence is orthologous to G409
atggcttgtgataggagcgcattgtatacctccagtgtcatcatgaacaccgaggacaacagttctgctcatgccatagctgccatgattgcaagttcttgtactccacctgcaacgtttcaaggtactcgatctataagtgtttttgaaactggaaatgagcgcaaacgaccagctggaaactcctactcggccttggaattgtctgatgacattggggatgaagatggttcggatgattgcatccatttgggagagaaaaaaagaaggctgaccttagagcaagtgagggctctagagaaaaatttcgaaatggcaaacaaacttgaaccagagaagaaaatgcagttggccaaggctctaggtctgcagccaagacaaattgcggtttggtttcagaataggagagcaagatggaaaactaagcaactagagaaagacttcaatgttctcaagcaggactatgatgctctgaagcaagattatgataaccttatggaagagaataacaatctccaggccatgatcgaacgtatgagcagtaaatcacagagctgcaatgaccagaaatttcaggcgaattcttccaaattacagaaagacgatcaggacttgcagcttctcatgatgtctgcaaccaaagttgattgtgcagacaaggaaaataataatgaagggccttctagcattggaagtgaaggcagttctgttttggacatggacagcccgggtaccattgacagccaacaaaatattgattctataggattctcgaacgtgaaagctcgtgaccttcggcttgaatgcaatttcaggcctaaagtagaggaaaatgtgagtcaagcagatgaaccttgcaattacctgttttacaataatttggagactggtccgctcttgtgggattataattggtcttcaggcctctag

SEQ ID NO: 17035 - DNA, 887 bp, Picea glauca
  misc_feature (5)..(6): n is a, c, g, or t
  misc_feature (8)..(8): n is a, c, g, or t
  misc_feature (793)..(793): n is a, c, g, or t
  misc_feature (814)..(814): n is a, c, g, or t
  misc_feature (838)..(844): n is a, c, g, or t
  misc_feature (850)..(850): n is a, c, g, or t
  misc_feature (857)..(859): n is a, c, g, or t
  misc_feature (861)..(865): n is a, c, g, or t
  misc_feature (879)..(880): n is a, c, g, or t
  Predicted polypeptide sequence is orthologous to G409
actcnngnataagagaaatatttaataaacaaagtaggcttgcattcactctttcacctctactttgggcaacttacataagagaaacctggaaaccattagaaattgctatacatcacgatgaagagactttttatgcagccacccttcaaaatcttctaaacacttacaattgcaaggaaaactaaaccttgccaacagtacttctctattttctttcagagtcaattcttatatgctgttacatcattctgctcttattctgggcgagggagatggacagatgaacataacagcagcacgattctggctagtcccaccagggaccaagcggtacttgatcctccatagcaaacatttcattgtaggatgcaattgaagcatctgggtaagggccgtcttccaccttgaggagatgatatgtatatgtctgaggaagcagtttttcactcatgccttcttcttcttcttcttcatcagcatgtgagaggtctgattgatccgcttcaaaaagatgggagttcacatggtccaaggatgaatgcccacagtcaacgtggtgaggactgtcttcatccaggaccccactgctgtctgttccagagctcaaaagatcttcatgtttgcaacttggtggtgtatccttgatagaagtacctctttcaaacttctcaacacactgggaggcgggctggggaaagactttcttatcaacatactcggaatcctttgtttgggcttcaaggtcacagtctttagagtgtaacttgcctgttaggaaggtaacctcagnccttaatttatccttttcttngagcaggctatcgtaatcgactcnnnnnnnctcatngcgtgannncnnnnnatcataatccctcnncaattgc

SEQ ID NO: 17036 - DNA, 838 bp, Picea glauca
  misc_feature (2)..(2): n is a, c, g, or t
  misc_feature (13)..(17): n is a, c, g, or t
  misc_feature (19)..(19): n is a, c, g, or t
  misc_feature (24)..(30): n is a, c, g, or t
  misc_feature (41)..(45): n is a, c, g, or t
  misc_feature (113)..(114): n is a, c, g, or t
  misc_feature (803)..(808): n is a, c, g, or t
  misc_feature (828)..(833): n is a, c, g, or t
  Predicted polypeptide sequence is orthologous to G409
angagaaattgannnnngnggtcnnnnnnntgacagacaannnnnatgccaaagagaaaggtttggaaatccaaacaaatgatttggagacaacatgtaaaaaagcattcatnnaatccaattcccagtttgagagcttggagaaatctgggattgtttccaaaggcatgactgccccttttgatcagcaactggtgagctatagcattgaagaccctcttagttccggaacagacggaagtgctgtcgtagatgaggaaagccctcatcacattgatagtggacattcttcggttgtaggctatgtcacctcaacccatatttcaccctttgaagcagatctgtctgacttttctcatgttgatgaagaagaagaagaagaaggcataagtgaaaagcttctacttcctcaggactgtcatatgaaaatggagtgtatactcttcccagaggcaccaacaacatcttgtacttatgtatttgccatggacgatcaagaaaatctttcgtggtgggactggccataagtggctaatttgctatttagttcattttgtacaaatctatctcactagagcaaaatggtctaatatcaagtagagatccactctccattacttgagaaagtagacttgacatggtaacgtttgtcctccaggttgtaagtgttctggagagtgggctctttgaagcttcctgtatctattaatggatttgccacgttgaactggtttttggtttacatgttttaggaatagatatggcaaactattgtaggtgggacagcaactgaaggcctgctnnnnnngatgaattttttaagcagannnnnnatctt

SEQ ID NO: 17037 - DNA, 831 bp, Picea glauca
  misc_feature (734)..(738): n is a, c, g, or t
  misc_feature (740)..(740): n is a, c, g, or t
  misc_feature (749)..(749): n is a, c, g, or t
  misc_feature (767)..(773): n is a, c, g, or t
  misc_feature (797)..(797): n is a, c, g, or t
  misc_feature (803)..(803): n is a, c, g, or t
  misc_feature (805)..(807): n is a, c, g, or t
  misc_feature (813)..(818): n is a, c, g, or t
  misc_feature (822)..(828): n is a, c, g, or t
  misc_feature (830)..(830): n is a, c, g, or t
  Predicted polypeptide sequence is orthologous to G409
tttcttcttatttctcaattcctccgcctctgcctatgtaaattctcacaataatatatatatatatatatatatatatagccattctcaatccatttttctataatctgtgttgtttctggtttttctgttgtagtgagaaagatttgagtctctgtgtttgctaaggaaatttagtgttggtagactctcgaagcgtatagcagagagtctgtaaacatggatattatggcttgctcactgggatcccgtatgcgtacgttgtggagcacaagcttctttcgtcacaagcactttctctagtagagccattatcagaagaactttaggaagcgagggttagctgtctgtattaaataaaaaatggcgtccaatggggttaggttcaatgcctccaatcgaaatttgatcgtcatggtgaatgaaactccgtctttcgaagctgattcaacgcctctaaccagtttggatggagtgatgaagagtgtgtcaaagaggccattctacaatacacttgatgcagaagaagcaggggatgaggatttgctggacgagtgcgttcatcagccaggaaagaaaagaagactttcggcagatcaagttcactttctggagaagagttttgaggtggacaacaagcttgagccggagcgcaaaactcagttagctagagatttgggattgcagcctaggcaggttgcagtctggttccagaatcggcgtgccaggtggannnnnangcaattagngagggaatatgacattcnnnnnnnaagctatgacactctcagggtggnttatgntnnnttactnnnnnnaaannnnnnntng

SEQ ID NO: 17038 - DNA, 877 bp, Picea glauca
  misc_feature (802)..(807): n is a, c, g, or t
  misc_feature (810)..(812): n is a, c, g, or t
  misc_feature (827)..(831): n is a, c, g, or t
  misc_feature (854)..(869): n is a, c, g, or t
  misc_feature (875)..(875): n is a, c, g, or t
  Predicted polypeptide sequence is orthologous to G418
atataacgaagccatggcgaattggtagaatcactgacctggtttatgagcttagccagccggcctttattttatttgaacaattcatccaaacctaattgtcttgatggcgaaggaggcgccgtcaaacggcggcagcagaagaagagacagagaggtggagcgcggcaaggcgagaagaattagcagaccatcgtcatcttcagtacagcgtcccaagagagtgacgtttaaagctgaggatgaggttatcttctcagacttgaccaacaatatcatcaacttggcggcggactccatgaataatttcagcagctctctgtttgattcatatgaaattaaagcactgtccaagtatgtattatctctgaatcctcctgctagctatgatgatgatgatggtgtgagcaagaaagggtggaaagagtttggtttttcttatgatgactgccttcccagcggcggcatgagaggatttaagttcggcagcagagccaggaagcggcggttcctgcatgtgtggtttcccatgaagaaataagggtcgagtagagtaagtattactgtgcagcttaatcccgttgtgccagtcatgatagcttgtgatgaaatatggcacagggtagggtttgattactcagattggcgacgatataaatttgggaacgacggaggatggtattacagtatttcaaagtcagaagtgttaaggtagttagggttagggtttctgataaagttatttctaattgaaatttgttttcacttcagaaaatttaattttcttcaaaaatgatgtatnnnnnnatnnnttctgtcatatgccnnnnnatgagtcttcatcacaagcatannnnnnnnnnnnnnnnctatantg

SEQ ID NO: 17039 - DNA, 918 bp, Picea glauca
  misc_feature (778)..(780): n is a, c, g, or t
  misc_feature (839)..(841): n is a, c, g, or t
  misc_feature (854)..(854): n is a, c, g, or t
  misc_feature (857)..(861): n is a, c, g, or t
  misc_feature (863)..(868): n is a, c, g, or t
  misc_feature (912)..(916): n is a, c, g, or t
  Predicted polypeptide sequence is orthologous to G427
ctccaacatccactgtatgaccagttgttggctgctcatgttgcctgcctgaggattgcaactcctgtggatcagctgccaaaaatagatgctcagctggctcagcaacatcatgttgtggccaagtactcagtcctaggaaggaaccagctcttgactggagaggagaaggaggagcttgacaggttcctggcacaatatgtgttgttgttatcctcttttaaagagcagctgcagcaacatgttcgcgttcatgcaatggaagctgtgatggcttgttgggagcttgagcagtctctccacactcttacaggagtgtcgccgggagaaggcacaggtgcaaccatgtcagacgatgaagatgaccaagcagacagtgacacgaatttattcgacttgggtttagatggacaggacggtgtaggatcgtttgggccattgattccaactgagaatgaacgctctttgatggagcgtgtgaggcaagagctcaagcacgagttaaagcagggatatagatctagaatcgaagatataagggaagaaatccttagaaagcgcagagcaggcaaactgcctggtgatacaacctccgtattgaagaattggtggcaggcacattcaaaatggccttatccaacggaagacgagaagacgagattggtccaggaaacaggccttcaactgaagcaaatcaataactggtttatcaatcaaaggaagcgtaactggcacagcaatccttcgtcatcttctgcttcaaatgctaaacgtaagnnntaatggcgatcgagttgatatacattatatataaatatacttacaccccacacaaagtnnngcgagatctgatngcnnnnntnnnnnnatgcttactgtacaaattattaaccaatcgtaggtttacagcannnnntt

SEQ ID NO: 17040 - DNA, 428 bp, Picea glauca
  Predicted polypeptide sequence is orthologous to G438
tgatttagatatttttaatcattggtttgatatcaatgttttagatgcttcagtgacgccgttgtaatatatggaaaggttttcaaaggtcttatatgtggtcaaacaatctctttaaagcatacattacggtcttctggaaagataacatgccccttgtctgcttgaagttgtgatatgtgctattacatgggtttcagttgggatgaatgctgtgcatcatatgcatcttgttttgtaatatcttctgagaggttggtgtgaccctcatatgaagtccaaactgtccccttgatacttaaattttgtatgatttcctggtatttactggtaccctgacatggttgtatgatgtatccctgagaaagcactaattaaaatatgtgctgctctgattgaggtgcagtaattattcaaagacatttttt

SEQ ID NO: 17041 - DNA, 877 bp, Picea glauca
  misc_feature (803)..(807): n is a, c, g, or t
  misc_feature (821)..(822): n is a, c, g, or t
  misc_feature (824)..(826): n is a, c, g, or t
  misc_feature (836)..(842): n is a, c, g, or t
  misc_feature (854)..(854): n is a, c, g, or t
  misc_feature (856)..(863): n is a, c, g, or t
  misc_feature (865)..(871): n is a, c, g, or t
  Predicted polypeptide sequence is orthologous to G447
gcagcctacatcattgcagaaaccacttccattgcagcagcagttggcaccatctatgcagcaacaacatcagcaacctcaacaatcttactcgcaagtccaacagtcccagcaatctacacagcagtttgggcaacataggcaatcgtcacagcctgctgtgcagcagcagccttcacttggtcaattatcctcatcacaacagtcattgtcattatatggccaaccaccagtttctcagcctcaaatgcagccacatgttagcccggcactgcagcaggttcctcctagtttacagcagcagcaccacttgccaattgctgctcttcaacagcagaagcagcagcaggtgccacaatcacagcctcagccacaggtgcagccacagcaacagcaacaacaacaacaaccacaaccacaaccacaaccacaaccacaaccacagcaacagttacaacagcagcaacctccacagcagttacagcaacagcaacaaccacagcaacagttacaacatccacaacatattactatcccacagcaggctcatagtgcccagcctggttttcaatctcagcagtatccatatttacagcagcagcatcagttccatctggtgcaatcagcagctcacactcagccacagccacagccacagccacagcctgtacaaactcaaaagcaacagacctattatcaggtggctgctcagcctgtgcagcaacagccttcctgggctcttccaacacagtcccaaacagtagttagtacccctgctattgtcagtgctgctttggcatcgnnnnntacctctgttgtgnntnnngtcagtgcannnnnnnctgctcctatancnnnnnnnngnnnnnnncataca

SEQ ID NO: 17042 - DNA, 924 bp, Picea glauca
  misc_feature (2)..(10): n is a, c, g, or t
  misc_feature (13)..(15): n is a, c, g, or t
  misc_feature (19)..(25): n is a, c, g, or t
  misc_feature (43)..(43): n is a, c, g, or t
  misc_feature (57)..(57): n is a, c, g, or t
  misc_feature (59)..(59): n is a, c, g, or t
  misc_feature (61)..(61): n is a, c, g, or t
  misc_feature (74)..(75): n is a, c, g, or t
  misc_feature (87)..(89): n is a, c, g, or t
  misc_feature (94)..(98): n is a, c, g, or t
  misc_feature (921)..(923): n is a, c, g, or t
  Predicted polypeptide sequence is orthologous to G450, G456
cnnnnnnnnngannngaannnnnnnctcccaggagcagctgcngatgagtcacgagnangncagaggagctgtnngaaaagaagctnnncggannnnntggagtctggaaactataccattccagatgaggacattacaaggaccggcacacatgaggacgctgataaattcaatggaccaatagtcaaagaaaaacaaatggcccttgctgccaatgaccctgcaagattggaacctcgacctcctcccaaggcacagattgtaggttggccacctgtcaaagatttcaggaaagtgagaacgattcctgcatgcgactctctgtatgtgaaagtgagcatggatggagctccctatctccgaaaagtgaacctcaaaatgtacaatacctaccacgacctctcctctgcactcgagaagatgttcagctgcttaattaccatgggcaagagtcgatcccatgggttgaacgagagcaatttgatggatgtgctgaatgggtcacaatatgtgccgacctatgaagacaaggatggagactggacgaggggggaatctcgcctcagtctcctgactaatctaatctcgacataactgggtaaaaagtgactgttatttgcaaaatatataccgaatattcatggatgtaaggacctgggtttcccattaagttctgtgcagtatacaaagatgatggttagccatggatccaggaatttcagtgtgtatgttcattagaacgattgatttttgggaggctgatttgctcttatactaattgtacttattgagcacgacgctcttttgttattgtttgagatggaatatgtatgttcatccacgatagctcaagatcaaccagctcttgacccttcacaatttacgaattcaatctgaaactgatctgtatttatattttnnna

SEQ ID NO: 17043 - DNA, 886 bp, Picea glauca
  misc_feature (45)..(50): n is a, c, g, or t
  misc_feature (753)..(755): n is a, c, g, or t
  misc_feature (757)..(757): n is a, c, g, or t
  misc_feature (766)..(767): n is a, c, g, or t
  misc_feature (797)..(799): n is a, c, g, or t
  misc_feature (801)..(801): n is a, c, g, or t
  misc_feature (814)..(814): n is a, c, g, or t
  misc_feature (845)..(846): n is a, c, g, or t
  misc_feature (868)..(875): n is a, c, g, or t
  misc_feature (878)..(884): n is a, c, g, or t
  Predicted polypeptide sequence is orthologous to G450, G456
gtaataataacgataaggaacccactggatcgagagcaaattaannnnnnttgctactcgattcgttgaaacattaattatggcaaggttcaaaataaaatagccttcagtagcgtttaaaacatttaaaaaacacatagacagagtaataattattccactgcgtgcactcgttgtgaaatatggtacacagaatgcatattaatgacgtgctctcgtagtattgctgagtttattgatcgttcccaggcacctgaacgctgttcattgctgccactaaagaattacaagtcccaccattgagggacacagtgtggttgaggagcgtcctgacctgcttctcatcaaaacatttcaccatatccacccttcttatcaacttctgcaaaccccaagatgtgctttactcgcgcaccctcttgaaatacaaagccacatactctcacagtctcgcagttccagaaagcaggtcatgctccacctccacctctaatacttggacttggacttctccatggccctcggagctaaaccaatagcttctgaggccttcatgatgcgcaacctcttgcaagaatctacaaacatcatccagggaacatcgccaacaagcatccaatctccatccttatcttcgtaggtaggcacgtattctgatccactcagcagatccatcagcttgctctcgctcaggccaggggatccacattgtcccatggtgaagcagctgaacatcttctcgagtgcagaggnnngntccttgtanntgctgtaaattttaaggtccacctttctgnnntngggagctccatcnatgctcaccttcacatacaaagcattaccannaaacccatcgtcggtaggcttnnnnnnnncannnnnnntg

SEQ ID NO: 17044 - DNA, 900 bp, Picea glauca
  misc_feature (4)..(9): n is a, c, g, or t
  misc_feature (22)..(22): n is a, c, g, or t
  misc_feature (24)..(26): n is a, c, g, or t
  misc_feature (28)..(28): n is a, c, g, or t
  misc_feature (31)..(36): n is a, c, g, or t
  misc_feature (40)..(42): n is a, c, g, or t
  misc_feature (56)..(56): n is a, c, g, or t
  misc_feature (61)..(65): n is a, c, g, or t
  misc_feature (127)..(129): n is a, c, g, or t
  misc_feature (872)..(875): n is a, c, g, or t
  Predicted polypeptide sequence is orthologous to G450, G456
accnnnnnnaaagggaacaaangnnngngcnnnnnngcgnnngcggccgctctagnactannnnntcccccgggctgcaggggatgcaagtcctttggctgaaaataataataataatcaggcgagnnncttgaatggaagggactatgtctttgtgtacgaagacattgaaggagatcgcatgctcgttggagatgtgccatgggagatgtttgtgaatactgtaaagagattgcgtgtaatgaagagctcagatgctggtcgtctagctaacaggacccagtgatcccgacactgcctgatgctgctggaattaagaaaccctaacaagcttatctctcaaagtaaccctaagaagggagatgagcccaaggttccctttttctgagagagttcacgagctattttatcctgctgcgttgtggactgaaacttgagggcagtttgtgtagcatatattggacaaaggagaaatcgatagaaaattgttgaatgcttcagttcgtcgagagataagtaagacggattaagcaaaataaaacagaaaattgtgtaaagctggctggtttggtccagtgagacctcgttccgtttatttttctggtgttgattgtactaccttgttcaattattgggtattcaggcctccattaaatgtttgctgttcaagataccgtgctttcctcagcgactctacaacattgtagagctccacgacgatctgtcaattctgacgactccagtgagaggctacaggtatgtgattggctaacagctcaaaccatagagtgccttctctcttcttctttttatatgtattattaattcccacatgtatattatgaacagtggtgttcttttatagacaatcnnnnccacatttataacagtaaaggaatt

SEQ ID NO: 17045 - DNA, 913 bp, Picea glauca
  misc_feature (5)..(6): n is a, c, g, or t
  misc_feature (8)..(15): n is a, c, g, or t
  misc_feature (18)..(19): n is a, c, g, or t
  misc_feature (24)..(24): n is a, c, g, or t
  misc_feature (32)..(37): n is a, c, g, or t
  misc_feature (40)..(40): n is a, c, g, or t
  misc_feature (43)..(51): n is a, c, g, or t
  misc_feature (78)..(78): n is a, c, g, or t
  misc_feature (89)..(94): n is a, c, g, or t
  Predicted polypeptide sequence is orthologous to G464
gtatnncnnnnnnnncanngatgncgtgcctnnnnnnagnaannnnnnnnngaatgctcatgacagttatgaagctcntgctcaggccnnnnnngaaatgtttcaacggcccaacaatgccaacggccaaagtggacctcaaacaccgatggaaagagggcatgttggtgccaatgatcccaagcaatcaaggcttttggacagctcctcagactttgtgttgacctacgaggataaggagggagattggatgcttgttggcgatgtcccatggaggatgtttgtcaatactgtcaaaaggctaagggttatgaaaacctcagatgccaatggtctagctccaaggtgtccagagaagatagatgggcagaagagtaaagctgtttgacagagcgcactgtaagatcggagctagattttgcatctagctttcagtatactgcattggagtgggatggattccggctttccagctttctgtctttatcctctcgcacagagtgattttttttgggacatccagatttctgacctagagtctagccatactctatgtttttgtccatgtaatgtgatataatatcaactgatatatctgtatcaaccttcatatgtttatgcggataaagtatactatgtattcagttttgtcttttcactagattagagatccaggccatagggagataccatttatgcccagtttttgggtctggatatggggaaacagtcgagatttatggtgggactaagttattgttagtggctttcatactggctttttcctcatctacttttgtacagtcaaaatttccaacatgcaagtgttctgacttgttatattatgtttattttggaaattgccaatcaaattgtacattcaaggatgcagaggaacaatttgattatctta

SEQ ID NO: 17046 - DNA, 822 bp, Picea glauca
  misc_feature (7)..(11): n is a, c, g, or t
  misc_feature (618)..(619): n is a, c, g, or t
  misc_feature (631)..(631): n is a, c, g, or t
  misc_feature (728)..(729): n is a, c, g, or t
  misc_feature (739)..(740): n is a, c, g, or t
  misc_feature (755)..(758): n is a, c, g, or t
  misc_feature (760)..(767): n is a, c, g, or t
  misc_feature (769)..(770): n is a, c, g, or t
  misc_feature (776)..(776): n is a, c, g, or t
  misc_feature (780)..(780): n is a, c, g, or t
  Predicted polypeptide sequence is orthologous to G483
tatgaannnnngtgtttccacagtacgaccttccagtgtgagccaagatcactttgagaggaaaggatctgttatagataggtatcgattcaacagtggttaacttctctatccccgacccactgagcttcctaacactgatgatgaaaacacaacaggacagagtgatctgtattaaaggttgtcctctttattgtaaccgtataaaattcgtattctggctgaataagaattttctgctgggtattccaaatgatttaatattcctgcaatttcatttgctgtattggaatacaaattcagccagtgtaggtgtacttccatataataatgcaatttccttcgctattttgaaatgttaaaaacaatcttttataattgattgcgtggattattatgctgtttaaaaaaaaaaaccagatgagggaggtggagcaggcgcaggacttcaaaacccacagcctgcctctagctagaattaagaagatcatgaaggcagacgaggatgtcaagatgatctctgcagaggcaccggtggtgtttgccaaggcatgcgagatgttcatactggaactgaccttgaggtcatggatttacacagaggagaacaagagaagnnctttgcagaagnatgacatagctgcagccattggtaggactgatatatttgatttccttgttgatattgtgcctagagatgaattcaaggatgaggggctggtgatccnnagagctgcanntgccgtgcccttcannnntnnnnnnnntnncgtgcnatcntattactatgttgcacagcaagctcccaacatggctgcttat

SEQ ID NO: 17047 - DNA, 872 bp, Picea glauca
  misc_feature (11)..(17): n is a, c, g, or t
  misc_feature (781)..(783): n is a, c, g, or t
  misc_feature (811)..(814): n is a, c, g, or t
  misc_feature (826)..(828): n is a, c, g, or t
  misc_feature (832)..(832): n is a, c, g, or t
  misc_feature (834)..(836): n is a, c, g, or t
  misc_feature (838)..(838): n is a, c, g, or t
  misc_feature (859)..(865): n is a, c, g, or t
  misc_feature (868)..(870): n is a, c, g, or t
  Predicted polypeptide sequence is orthologous to G483
ctaaaatatgnnnnnnnaatcctcaatgcaacacatgccgatacaatattacggtgcaacgccttatcagactgcgcagattctgccctccattgctcatggaacgtttcagcagcctctcatttcttcaaatgctcatgcaactgctttacctttatctgcccatctgaatcaattggcttaccaccaccaaaagcatcagggaaaagttgagattagctgggccaaccagatgcagggaatcgagcaagctgtcgatttcagaaatcacagcctccctctggcgagaatcaagaaaataatgaagtcagatgagcatgtgaagatgatatctgcagaggccccggtggtttttgccaaggcgtgcgagatgttcatcaatgaacttactctcagggcctggaatcacactgaagaaaccaagagacggaccttgcagaaaaacgatatagctgcggcaatagctagaactgatatattcgattttctgatcgatattttgcctagggacgagttgaaggaggatcaggttattactcttggaacccctacatcttctctctcagttggaggcagcagttctaacgccggtgttgctaattctttcccttattattatttacccaaccagcactctgcgcctcatggagtgactgttgggaatcccatgcatcctgctatttatatgcagcagccccggtctcctgcggcctatatgcagaatatgttgcagcggggacacatgcacacagaccaatcaaggtcacacaattctggttannngcatggcctgatcatgagctggttcatnnnngcatgttttttnnnaatncnnnantggctcttcgtttgtctgccnnnnnnncgnnntc

SEQ ID NO: 17048 - DNA, 891 bp, Picea glauca
  misc_feature (773)..(774): n is a, c, g, or t
  misc_feature (810)..(816): n is a, c, g, or t
  misc_feature (845)..(845): n is a, c, g, or t
  misc_feature (857)..(862): n is a, c, g, or t
  misc_feature (874)..(881): n is a, c, g, or t
  misc_feature (885)..(887): n is a, c, g, or t
  Predicted polypeptide sequence is orthologous to G483
ggcattgatattgtttcagatccatgcaaacaacccccaggtgtcagaagtacacaggaccctcagaaaaatggtgaattgggctgaatacggagatcagaattgaggtgagaagagcaggcaatctgtgatcagaagaattgggtacttggaatcgatggatcagcagcagcccacaataccagcactacctcaagtgggttatggcacaaatccatacatagcccctcccattggtggtcctccacatccagttagcatcataccatcaacaacttcaggccttctggggtaaccagatgagggaggtggagcaggcgcaggacttcaaaacccacagcctgcctctagctagaattaagaagatcatgaaggcagacgaggatgtcaagatgatctctgcagaggcaccggtggtgtttgccaaggcatgcgagatgttcatactggaactgaccttgaggtcatggattcacacagaggagaacaagagaagaactttgcagaagaatgacatagctgcagccattggtaggactgatatatttgatttccttgttgatattgtgcctagagatgaattcaaggatgaggggctggtgatccccagagctgcaggtgccgtgcccttcatgggtcctggggataacgtgccatcttattactatgttgcacagcaagctcccaacatggctgcttatgcccctcctactcagcaaatgaggtccaaagcacctgcacctcctcatggcagcagttgagggttctttgannacgtaattaggtgggtactaacaaatgcatcttcannnnnnnactaccagggattgaagctttctagagtngatttcaggcgnnnnnnttgtgtttgttnnnnnnnntatnnntgga

SEQ ID NO: 17049 - DNA, 893 bp, Picea glauca
  misc_feature (793)..(793): n is a, c, g, or t
  misc_feature (801)..(801): n is a, c, g, or t
  misc_feature (803)..(804): n is a, c, g, or t
  misc_feature (845)..(845): n is a, c, g, or t
  misc_feature (850)..(856): n is a, c, g, or t
  misc_feature (858)..(860): n is a, c, g, or t
  misc_feature (873)..(873): n is a, c, g, or t
  misc_feature (875)..(885): n is a, c, g, or t
  misc_feature (889)..(892): n is a, c, g, or t
  Predicted polypeptide sequence is orthologous to G483
taccgaagatttgccagcgctttttgggttcagaagccagatttcgccatctgttgaagagcgcctggtttcgatccagaattctgggattgctgcattgggcttcgactttggcaaaatatggaagagcactccgcaatgcaacacatgcccatgcattacagggcaatgccttatccgaatgctcagattcaacccaacattgctgctcatggagcgttccagcagcctcctattcatgctcatcatcatgctttatcttcccaccacaatcaattgccctaccagcaccagcagcaaattcaccagcaccaacggcagctgcatcaccagcagcagcagcagatcgaggttttctgggccaaccagatgcaggaaattgagcaagctgtcgatttcagaaatcacagtctccctctggcgagaatcaagaagataatgaagtcagacgacgagaatgtcaggatgatatctgcggaggctccagtagtttttgccaaggcttgcgagatgttcatcaatgaacttacgctcagggcctggattcacactgaagaaaacaagagacggaccctgcagaagaacgatatagccgcggccatagccaggactgatatattcgattttctgatcgatatcgttccccgggatgagttgaaggaggatcaggttattaatcttggaaaccctagatctgctctctcagttggaagcagcagcactaacgctgctgctggtgctaattctattccttactattatttacccaaccagcattctgtgcctcatggtntgtttgtngnnaaacccatggatcccactatttatatgcagcagccgcagtntcccnnnnnnnannngcctaatatatgncnnnnnnnnnnnatgnnnnc

SEQ ID NO: 17050 - DNA, 561 bp, Picea glauca
  Predicted polypeptide sequence is orthologous to G484, G2631
gttgaatgctgtgtagagtttatcaatttaatctcgtcggagtccaatgacatatgctacaaagaggagaaaagaactattgcaccagaacatgttcttgaatctctaaagattcttggctttgggagctatattagggaggttaaagctgcttatgagcagcacaggattgagaattgggattgtccaagagcaggaactagatggagtaaaaacagactggaaatgacagaagaggaagctttacttgaacagcagagaatgtttgcagaggctcgtgcacgcatgaatagtggaaataataattttcctggacaattgcaatcgcaatcgcaatcgcaatcgcaatcgcaatcgcaatcacagtcagagtgattgatactgaattctttcatatgttcatgcgaggatcatttattatatttttgactagttgtataaatgtcatcatcctatagttaaatctatcagcaatactaataaatattctttcctggagattggctaagcagctcctgtgttctgcacttttcttttaatttgtcatccattcttctgtgt

SEQ ID NO: 17051 - DNA, 852 bp, Picea glauca
  misc_feature (4)..(8): n is a, c, g, or t
  misc_feature (21)..(26): n is a, c, g, or t
  misc_feature (730)..(730): n is a, c, g, or t
  misc_feature (732)..(732): n is a, c, g, or t
  misc_feature (771)..(774): n is a, c, g, or t
  misc_feature (813)..(819): n is a, c, g, or t
  misc_feature (832)..(836): n is a, c, g, or t
  misc_feature (841)..(845): n is a, c, g, or t
  Predicted polypeptide sequence is orthologous to G522, G1453
cagnnnnnaggtatccaagtnnnnnnggtacatcttacaaaagtctatcttctaaaatttagcagtgaattatatagtggtaatccaataacgttgcattctgactatggtcatagcatacagtacatgaccagttcatccactggtctactaaaagttgcatgatagaactaaagggatataaatataagttttaacacaattaatgtagctgcagggctataagtatccagcttatgtatctcactcactgtgaaattctacatgttaatatgatagctcacccagctagcttattcgtgtacaaatttgtctacattttacagagggctgcgagacttcactaatgatctgaccacatatttattgattgcttccatgtaactctgttggctgatttcttccaattgtcttctgcaccccctcaaggactgaggttgggttaatcaatcgaccatagactgcctatcaaatccgatgcttttagatgtaatttattatgtacatgaaaagccagttaaagttaccatttgttcatgtaattgttgtgggagagctgatcattttcctgcaaagctccagagatcaacatcacagttggaatttgaggcataatctccttgctgctcatgtttattagactgtcgcagaagtacagtcatatgatcaggtatgggatacattgtttcgttaggaaacctagcatcctttgacacgtcctcctggctcngntgtgaagctacaaatttatccagcactctccagtcagtnnnntgctcctcgttgtatgtgttaacagcgtgttgatcttcnnnnnnngctgctgactgtnnnnnggcannnnnatgatgt

SEQ ID NO: 17052 - DNA, 853 bp, Picea glauca
  Predicted polypeptide sequence is orthologous to G536
ttttttttttttttttttgggtacgatatgttgggtttcaaacacgcatgcagtttggtcttcggctcaagcccaggtgtctcccggccggcatcgctagaacgccccaatggcaatggtgatctctgttccggagtaattctgttctattgcagcaacctccacgcttcatcacacagtctactgggcaactggtgtctcctctgtcgtcgcgggtggtgcttcagcacttgcaccctcttccgcacgcggctgagcactctcgccctggttctcagtctcagatgatgtccagagagtaaggttgtcacggagcaattgcatgatcaaggtcgagtccttgtagctctcctcggacagggtgtcgagttcagcaatagcatcatcgaaagcctgcttagcaagatggcaagcctggtcgggagagttcaggatctcatagtagaagactgaaaagttcaaggcgagaccaagacgaatggggtgagttggagcaaggtctgtttgtgcgatctcggtagcagccttgtaagcctcgagggactggtcggcagaagtcttgcgcttctctcccaaggcgaactcggcaaggtagcggtggtagtcgcccttcatcttgtggtagaaaaccttggactcgccagtttgagcggacgggatcaagtgcttgttcaagacctcgagaatatcctcgcaaatcttggcgagctcggcctcgatcttttggcggtattccttgatcaaatcgacttgcgggctgttccctttggactcctccttctgctcgatcgaggtcacgattctccaggaggcacgacgagctccaatgacgttcttgtaggccactgatagg

SEQ ID NO: 17053 - DNA, 1081 bp, Picea glauca
  Predicted polypeptide sequence is orthologous to G536
acgaggcactgcccttcattgtctcgctgtgcttctttcacagaaaatccattcacagttcacagtccttggtttggtttcgccattttagtgtacttcttccttttagtggccgtttgttgaagatccagaggtaaagttgggcgtttaagatctgtgcagagatggcggcagcggcgatggtggagtcatcgcgggaggagaatgtatacatggcgaagctggctgagcaggcggagcgctacgaggagatggtggagttcatggagaaagttaccaaaggcgtggaggtggaggagctcacagtcgaggagcgcaaccttctctctgtggcctacaagaacgtgatcggtgcccgccgggcctcctggaggatcatttcctccattgagcagaaggaggagagcaggggcaacgacgaacacgtggtcaccatccgggagtacaggtccaaggtggaatcggagctttccaagatctgcgagggcattctccgcctcctcgactcccatctcatcccttcttccaccgccgcggagtccaaggtcttctatctcaagatgaagggcgattaccatcgataccttgccgagtttaaaacaggcgccgagaggaaggaggccgctgagaacactttgcttgcttacaagtctgcccaggatattgctgcggcagagttggctccaacgcatcctattaggctagggctggctcttaacttctctgtattttactatgagattttgaattcgccagatagagcctgtaatcttgcaaaacaggcatttggtgaggcaattgcggaattagatactttaggtgaagattcttacaaggatagcactctcatcatgcagctgcttcgtgacaatttgacattgtggacctcagacatgcaggaggatgctggggatgagatcaaagagacttctaagcgtgatgaaggagaggagcaatagtgaaatatgatgatctattagtatattaggattagattagcaggctatcctgcattgtttggtaaaggaggctatgtgcacgaatgtgtttattagatctcatgctctgcagtatttagttg

SEQ ID NO: 17054 - DNA, 770 bp, Picea glauca
  misc_feature (646)..(647): n is a, c, g, or t
  misc_feature (676)..(679): n is a, c, g, or t
  misc_feature (716)..(718): n is a, c, g, or t
  misc_feature (721)..(728): n is a, c, g, or t
  misc_feature (737)..(742): n is a, c, g, or t
  misc_feature (757)..(758): n is a, c, g, or t
  misc_feature (762)..(763): n is a, c, g, or t
  misc_feature (766)..(767): n is a, c, g, or t
  Predicted polypeptide sequence is orthologous to G536
ctgcaaggaaatatgaaaaaccagcaataatcgtaggccatccatattacaacccaacaaatattcctgctaattcatagttgacggacaaagagactaacaccaagtgacaatagtaaggtacagcaaatgagaaaatctcaaaaacctctcttaaagtatagcaatgacacaacaatgtgagaaaatcatcctcctcccattcactcatcagagttccggtcgcatcatcactcagcatcttcacccccaccagcttttgcagaggtttccatcttctggtcttctccatcctcaggaatatcagaagtccacagagtgaggttgtccctcaacagttgcataatcaaagtgctatccttgtaagactcttcactcagggtatccagctctgaaatagcttcatcaaatgattgcttcgcaagatggcaggcccgttctggtgagttcataatctcatagtagaacacagagaaattaagagccaaacccaatcgaatgggatgggtgggagatagatctcttgctgcagttgatgtagcagtctcatatgccttaagtgactgatcagctgcctctttcctctcattaccactcttgaactctgctagataccggtaataatcacctttcatcttatagtagnncacagcggattccccaggtatagatgatnnnntgagatgctcatcaatcacagtcatgatatcattgcnnncgnnnnnnnnctctgcctnnnnnntcttcctatactctnngatnntcnncac

SEQ ID NO: 17055 - DNA, 923 bp, Picea glauca
  misc_feature (771)..(771): n is a, c, g, or t
  misc_feature (788)..(794): n is a, c, g, or t
  misc_feature (810)..(811): n is a, c, g, or t
  misc_feature (813)..(813): n is a, c, g, or t
  misc_feature (828)..(829): n is a, c, g, or t
  misc_feature (870)..(885): n is a, c, g, or t
  misc_feature (891)..(896): n is a, c, g, or t
  misc_feature (898)..(898): n is a, c, g, or t
  Predicted polypeptide sequence is orthologous to G536
cataaaaaatattattcaacacaaaggcagaatgggcctacagatttgttgatagactccaccaatctgctattacagtaccaagccactgtctccaaccattcgcaaatagtatggatcatttaaaatgccaacataagcgcagctaacaaaagatgattaagaatatgctacccacagcaactaaatactgcagagcatgagatctaataaacacaatcgtgcacatagcctcctttaccaaacaatgcaggatagcctgctaatctaatcctaatatactaatagatcatcatatttcactattgctcctctccttcatcacgcttagaagtctctttgatctcatccccagcatcctcctgcatgtctgaggtccacaatgtcaaattgtcacgaagcagctgcatgatgagagtgctatccttgtaagaatcttcacctaaagtatctaattccgcaattgcctcatcaaatgcctgttttgcaagattacaggctctatctggcgaattcaaaatctcatagtaaaatacagagaagttaagagccagccctagcctaataggatgcgttggagccaactctgccgcagcaatatcctgggcagacttgtaagcaagcaaagtgttctcagcggcctccttcctctcggcgcctgttttaaactcggcaaggtatcgatggtaatcgcccttcatcttgagatagaagaccttggactccgcggcggtggaagaagggatgagatgggagtcgaggaggcggagnatgccctcgcagatctnnnnnnnctccgattccaccttnnanctgtactcccggatnntgaccacgtgttcgtcgttgcccctgctctcctccttctgnnnnnnnnnnnnnnnnatcctnnnnnngncccggcgggcaccaatcacgttctt

SEQ ID NO: 17056 - DNA, 707 bp, Picea glauca
  Predicted polypeptide sequence is orthologous to G550
ttttttttttttttttttcggacacaaaataactcagctcaatttaataaacggaaaaggcatgcaatctaatatgcagagatatacatagcttttcgataaagccttattcagcggcttgttgtgtgcagttagggatcatgggtttgccatacagtacacggcaatctgcgagaagagatgaattgccattttgctggatttcaggaatccattgagaattttcggtgctgatcgcttttattttcagaccaggatccattaaattcgaaaaccctgtgccagaaacaccattgacagttaaagaattgacgaagctatcggaaatcgtagcgtccatttcttccaggcacggaaccttcatgtcgatccccgctacgccggtcaccgacgaaacgctggtcgattcatcgttgaagctgaaaattctcgtctcgttgacgggctcttcgaaattctcaattctcatctcgggctcttgcaaatcgagggatttcgaagcactgtgaagctgaaacgtggtgaaatgcttactctttctcctgccagcgccgacggggatgttccgcatggttcctcccgcagtccagtagcgcctgcagtttttgcagaaatgccgcggctggttaacgttgtaattgttgaagtaacagaattttgtctctgaactgtgacagcgggggcaggccactggctttgacggcttc

SEQ ID NO: 17057 - DNA, 822 bp, Picea glauca
  misc_feature (8)..(10): n is a, c, g, or t
  misc_feature (12)..(12): n is a, c, g, or t
  misc_feature (19)..(24): n is a, c, g, or t
  misc_feature (48)..(50): n is a, c, g, or t
  misc_feature (191)..(193): n is a, c, g, or t
  misc_feature (235)..(235): n is a, c, g, or t
  misc_feature (260)..(260): n is a, c, g, or t
  misc_feature (285)..(287): n is a, c, g, or t
  misc_feature (345)..(347): n is a, c, g, or t
  misc_feature (438)..(438): n is a, c, g, or t
  misc_feature (818)..(820): n is a, c, g, or t
  Predicted polypeptide sequence is orthologous to G557, G1809
tcccgagnnnanttcaaannnnnnctgtttagttcaaagtgatgcggnnnatggcagaaggtaaaacaggagcccgggactgcagcaggaggatgtaaaatatgcgtcatgccgaaacatccataatgaacattgcattgccttgtatgttcaggctttttttctcactgttggaagcgatcttgaataannncttgaacattcggtggacatgtttggttccttctagtgctanctgcattttctaccagtgattttanctgccagcaattttacatggggtannncagacaagccagagttcttcattggcagctctgttctctcaagactggacaacaatcnnngcagtctgttgcgcacactataaataacggaattctatactacaccataaagaacacacgcgtctaaaaagattgctgaggaacagagtanctgctcagcaactgagggtgaggaagaaggcttattcgaacaagttggaaatgaagtccaaggagcttgaacagaagaagagagggtgtcaactttccagagtgaatatctcatgcttaaacaggttctgaagaacatgacagagaggagcagaggaggtggatttcgtgaagtagaagggcagttatatgatttgcaacatttgaaagatgttgcagtggctcaaattcttttgtattgggctgtgttttcattttgtcaatcaccataaatcagttttcaaccttttcttaggacgtgggctatgttaacgtctaacatgttgacttttgttggaagccatttaaataaaaatagaaaaggaaattcctgcctttttnnnca

SEQ ID NO: 17058 - DNA, 871 bp, Picea glauca
  Predicted polypeptide sequence is orthologous to G558, G578, G629, G1198, G1806
ttttttttttttttttttaactcatgatcaagtcatattcatcattgaacaaggggagtccagatttttgtcgtatttctcacaaacaggggaagtatggcttccctgcatttgagattgaaatattacttgattaatgcagccaaacaaatgatatatactaatagaccaaaaactgtcgacctggctattatgttacatttgaaaccacagtaaaaagttacttgttcatggaggtccaaccttgtgtgattatactggataattacttctaaatactttacattcctatctagctaattcaaagaaataaagcctcctcagctttgaaaatcctatcttcgatgtcaagggaatagttagcttaatttcttcaatatgaaaggctgagaattatcccaggcacaactggattctcaaaaggtgatttcagacttcctcccacaacaatgatgcaacaagatttcaatcattgtacaagagttatttcaaaataccaaggggcaaagccaaacctctacacggttcgaagcatgtattctgtatttcatcttcaatacatccaccctcgcaacccttcatcaactccatcctgtcagagatggagaagccctttcaggattgctcatagacgtggctatgcccattgcctagggctgcaacatgatacagatcaaagcacataatttctaacaatttaatctctggggcgagcaagccatagagagctaagggcacgcagtctcactcccggtccgtttcgtctcaactaccaggtaaacaactgctactgcatgggattcgaacaccaggcggcctgtgtgtcggcgaagcaattactcaaagacaataacggctaagagcgcgttgt

SEQ ID NO: 17059 - DNA, 882 bp, Picea glauca
  misc_feature (778)..(779): n is a, c, g, or t
  misc_feature (786)..(786): n is a, c, g, or t
  misc_feature (843)..(845): n is a, c, g, or t
  misc_feature (853)..(879): n is a, c, g, or t
  Predicted polypeptide sequence is orthologous to G558, G578, G629, G1198, G1806
tttgtcgtatttctcacaaacaggggaagtatggcttccctgcattggagattgaaatcttacttgattaatgcagccaaacaaatgatatatactaatagaccaaaaactgtcgacctggctattatgttacatttgaaaccacagtaaaaagttacttgttcatggaggtccaaccttgtgtgattatactggataattacttctaaatactttacattcctatctagctaattcaaagaaataaagcctcctcagctttgaaaatcctatcttcgatgtcaagggaatagttagcttaatttcttcaatatgaaaggctgagaattatcccaggcacaactggattctcaaaaggtgatttcagacttcctcccacaacaatgatgcaacaagatttcaatcattgtacaagagttatttcaaaataccaaggggcaaagccaaacctctacacggttcgaagcatgtattctgtatttcatcttcaatacatccaccctcgcaacccttcatcaactccatcctgtcagagatggagaagccctttcaggattgctcatagacgtggctatgcccattgcctagggctgcaacatgatacagatcaaagcacataatttctaacaatttaatctctggggcgagcaagccatagagagctaagggcacgcagacgagaaaagtaatcactgatagcaagaagcgcacgtgctgcttggcgagttgtcaatatcctatgcatttgctgtagtgtctgttgccgcaaattgtcagnntggtgancaaaaccttcaagggtacctaacttgcccattgccattgccatttgtcccatatagnnngctacatnnnnnnnnnnnnnnnnnnnnnnnnnnnacc

SEQ ID NO: 17060 - DNA, 890 bp, Picea glauca
  misc_feature (22)..(26): n is a, c, g, or t
  misc_feature (812)..(817): n is a, c, g, or t
  misc_feature (854)..(858): n is a, c, g, or t
  misc_feature (864)..(866): n is a, c, g, or t
  misc_feature (872)..(873): n is a, c, g, or t
  misc_feature (875)..(886): n is a, c, g, or t
  Predicted polypeptide sequence is orthologous to G558, G578, G629, G1198, G1806
tactctaatattcacatctcannnnnattatttcaatttcttcttgaatcttgaccctgttttttcccatcatttatcttcctacatttgacctgaagctgccaagcatggacagagtcaaacttccatacacacccttctattcaatcttcttttgcaaattaaccgacacccaataattacatatacagtccaggcaattaagagataaaaatatcaaactaagaaaagttacaacattgaatatttgtacaatcttcagaaagctatacattttattctcaagaaagatgatgcaatgaggttctctaaagacatctttctttataatctatattctggctcacctgcttagcttccttccatgtaagttacaacactcgatgcttgaaagagttgtaacaaatgtgacatcaggctgttcttggctcttggtaaatggcctttaaacgaagtatagatgactagttttgtcagctcaagcagttcaccaatagacttcaagtcatctcagggattaagcttactcacgaggacgagcagcccataaagaactaagggcccgtaatctggtaaagtaatcccccatagcaaggagacctcgagctgcttgacgggttgtaaggatgcgttgcatctgctgcagagcttgttgacggagattgtcggcctgatgtacaaagctctcaagcatcccgagctttcccattgccattgccatttgccccatgtagttggcgacatttggtgcacccaatgaacctgctgccagagtgtcaaccagggactgctgaagtgcttccatgccttgnnnnnntgcatcctctgcctgctgtgatgacagtttcaagctnnnnnctgcgnnngattgnngnnnnnnnnnnnnctca

SEQ ID NO: 17061 - DNA, 691 bp, Picea glauca
  Predicted polypeptide sequence is orthologous to G571
ttttttttttttttttttgatttataatagcttgaatttacattttcttttaactttatcattcgtgggtctacacgttttattgaggtataaaataaaataaaacgggatctatgaaagaaaacgtctagcgtaaaaatacaccttgctttagcctcaaatgtttgtagtttaaaaagtaaaaaaaaatcccaggccaataagttagatctttctttgctcatcaactacacagtaacaataaataatagacctaatgatacatgacttaataaagaatgagctatggtgattgatacatgggggttagtagaggtgctcctgctaggaattcccacgaatagttaagagttccttgactttttttacctaaatgctgaaacatatatttatattaaaacatgacatcagtacatgacgagtgagagtgagcagtgctcgaacaattaatatgcttagtacaactagcatagcatagctggctgttgtcactgactaaacatgtgaatgaaggtggcctagtcagagatataaaagtgctctctgctgaggcctggaatgaatgtgtcagtgcccagtgctggtcttcagcctggtctggcttggcctggtcttctaatacaatgaaatcaataatgcatgaacagtacaaaatgaatatcccttgggaagggacgtgatcaatattact

SEQ ID NO: 17062 - DNA, 869 bp, Picea glauca
  misc_feature (810)..(810): n is a, c, g, or t
  misc_feature (812)..(812): n is a, c, g, or t
  misc_feature (817)..(819): n is a, c, g, or t
  misc_feature (831)..(836): n is a, c, g, or t
  misc_feature (840)..(842): n is a, c, g, or t
  misc_feature (844)..(844): n is a, c, g, or t
  misc_feature (850)..(854): n is a, c, g, or t
  misc_feature (860)..(860): n is a, c, g, or t
  Predicted polypeptide sequence is orthologous to G597
aggcagggactcaatgggtttgccttcacatgggccttttgccaggtcgaatgcagcaccgaacgccattgtaatacacggggcttccaatgtgaacacgatgaagagaaaaagagggaggccgaggaaatacgggccagacggcagcatggcattggctctgtccccattctctgcacttcccgggatgacggggtcttcttcacaaaagcggggtagagggcggccacctggcactggtagaaaacagcaattggctgcacttggctcagcgggggttggctttactccacatgttattaccatagcagcaggggaggatgttgcaacaaaaataatgtcattttcacaacaagggcctcgtgcagtttgcattctttcagcaaatggtgctatctctaatgtgaccgttcgccaacctgctgcttctgggggcacagtgacatatgaggatgttgcaacaaaaataatgtcattttcacaacaagggcctcgtgcagtttgcattctttcagcaaatggtgctatctctaatgtgaccgttcgccaacctgctgcttctgggggcacagtgacatatgagggccgctttgatatagtctccttgtcaggctcgttcttattaatggagaataatggggcacgcagaacaggtgggctgagtatttcattggctggccctgatggtcgtgttgttggtggagtggtagctggaatgttaatggctgccagtccagttcaggtgacaatatagacagatttcacaagtagatgttcgtttttttctctattggctaagtttgtcttgtncnaatgnnntgtaggtgattnnnnnnagcnnnantttggnnnnnaaaaanggtcaaggc

SEQ ID NO: 17063 - DNA, 841 bp, Picea glauca
  misc_feature (27)..(33): n is a, c, g, or t
  misc_feature (41)..(50): n is a, c, g, or t
  misc_feature (759)..(760): n is a, c, g, or t
  misc_feature (765)..(768): n is a, c, g, or t
  misc_feature (786)..(786): n is a, c, g, or t
  misc_feature (788)..(788): n is a, c, g, or t
  misc_feature (796)..(797): n is a, c, g, or t
  misc_feature (808)..(810): n is a, c, g, or t
  misc_feature (822)..(824): n is a, c, g, or t
  Predicted polypeptide sequence is orthologous to G597
gcgatagacaatcagtcaaagtacaannnnnnncgattcannnnnnnnnntacaattgagtatcccaaatcaaaggctatgcatggtccgcagaccagtaaagatttgcatggtcctctgaatagcagtaccatccttcggagaacaaaaacgaagagttctttgtctatgctgccaagcatgaaatataacatgtcggatcttagttcttaaattaaaacaggtgacagctagcagagcagttgcatctgttctgagaaacctataaattttcatctgttagtttgaaaacaattgcagcccatcttaaaacctgttggtagtcagtgcaaattaactgataaatgtggtcaatattcagccacagggaaagatcctaaggcttctattattatccaccgggtaaagacatgttaatatctgtgttacgtctaggctctcccatagactgagagccttgccaacccactgactggtaggaggccatgttctgtattggctgtgaaggggcactattaaaatctccaatgctttgattcattggactacctggacctccagaggactcgctcattgttccccgggaaacaggactagcagctgcagctcctccagaagcagttccttgcgctagtccagcagaaggctcaggattggctggcctaggctttcgaccatttgaaatgaagctccctacaacaacctgtacaggactggctgccattaacaatccagccactccaccacctagaacgcgtnnatcannnnctgccagtgaaacactangnccgccagnnctactgcgggnnncaccattttctnnnagcaaaaatgaacctga

SEQ ID NO: 17064 - DNA, 871 bp, Picea glauca
  misc_feature (776)..(777): n is a, c, g, or t
  misc_feature (831)..(836): n is a, c, g, or t
  misc_feature (849)..(858): n is a, c, g, or t
  misc_feature (870)..(870): n is a, c, g, or t
  Predicted polypeptide sequence is orthologous to G597
atgctatagaaaacacacaaaaaattccatataactacactgagatttataaagaaatccaagcatataagctgaactaagcagagtatagaagagtatttatgaatgaaaggagagatttccccggccttcatagttcagggccgacttcattcttacacgcaggattccaacagcatcatcacctccacggccccacgaatctcaatgctgctgctgctaataacaatgctatttctaatgtcaatccattctacatccaacagggaggcattggcgctcccgcttcactgcgctacatgcccaatccttcttcttctttagctattggcaatgccaatccaaataattctcctcaagaaggacctgcttcttcaccgggtcctcgtaatccactgcctcctagaatgggaatgaatatggggtttcgttcggagcctttgaagaaaaagagaggaagacccagaaaatacagtagcgatggagtaggtttgggactctctccattgactccaagctcacattcattatccgaaaaacgagcccgcggctccggctctggctccaacaagaaagttcagatggctgcacttgggagtgcgggtcatggatttactccacacatcatcacagttgcaaaaggggaagatgtgtcgaagaagatatcagagttcttgcagcaaggaccttgggcagtgtgtgtgctctcagctaatggaacaatttcaaatgtgactcttaatacagggatgccgactggcactgtgacgtatganngacgatttgaaattctttcattatctggctcttttgtactaactgaagctggannnnnncaaacacgaactnnnnnnnnnnctgtttctctgnc

SEQ ID NO: 17065 - DNA, 599 bp, Picea glauca
  Predicted polypeptide sequence is orthologous to G634
tttttttttttttttttgctgtcccttggctcatcgtagtcctctgatgagtctgaagaaaaactgataccctcgctggaattaagatctgtatttcctgcacttgttgtacccaccatgaaattgcctcctaaattattattatcctcatcttgtctagcactcataggatcttcatgagcctggactctaccacctccgttggatatggtactggcatcattcatggttttgttgctgttataaggaggtttgctattattgttagagtacaaagcttctagctggctgaaaaatctatagttttttccatcctgtcgtccaactcttccttccttggatcttttgtagtatttgtgaatgttctcaaatttttctttgcattttttgggatccctatgatagccaagctcctcgagtctccgtgatacatgctcccagagaggccccttgaggcttgcgtctcggaaattggcatccatttcagatcgaatcttgagaagagcgagagtttcttctctgggccatcgatttcctgcagatcctcctcctcctgctagtctttcacaatcctcaccaaccccaaatacatcatcatc

SEQ ID NO: 17066 - DNA, 869 bp, Picea glauca
  misc_feature (7)..(12): n is a, c, g, or t
  misc_feature (49)..(54): n is a, c, g, or t
  misc_feature (790)..(790): n is a, c, g, or t
  misc_feature (813)..(815): n is a, c, g, or t
  misc_feature (817)..(817): n is a, c, g, or t
  misc_feature (823)..(824): n is a, c, g, or t
  misc_feature (835)..(842): n is a, c, g, or t
  misc_feature (844)..(844): n is a, c, g, or t
  misc_feature (853)..(854): n is a, c, g, or t
  misc_feature (864)..(864): n is a, c, g, or t
  Predicted polypeptide sequence is orthologous to G634
ttataannnnnnatatatctagaatatgcaagtctcacagagtggtttnnnnnnggtggctgtcgtttccgcacgtctggctgagtggtggtttaatgctgttgatgctgctgctgctgcttaattttgagcttcatcggatagccctcccaattacatccattttctgctgccccagagaagaactgcacgcagttattattattggaggaggctccgggtgttgggtggccgttactgccattattgttattatcattgttgatattattgtgagtacaaccgccttcagatgatggcatgagctgtcctaggatctccacagcctctcggcgctcatcgttctcgtgactgcttgtgcagggttgcaatacgagttcgtcagtcgtggtctggtcatggacgccgtccggctggtttgatactttcgtactagtggatgtggcagtggtactgcttccgccgtttgagaatcccagagctccttgacggtagagtgaatcgagctgttgaaaataagggcaggtcttcgaattctcaggcctcttcctgttactgtccttggcttttctgaaatatttgtttatgttctcccatttttccttgcatctcttggcactacggtcgtatcctagacgagacatgttagtggcgatctcttcccagagggggcccttggcgccggcttcttgaaacctgcgttccatgttcgtacgcaggcggattaagctcataatttcaggtttcggccatcgtttgttgttcggatcgtaagtttctttttctctgntaaccatgtcctgctggtcctgnnntnctgganncatggtaatcnnnnnnnncngcggtgcgnntatttccggnagctg

SEQ ID NO: 17067 - DNA, 807 bp, Picea glauca
  misc_feature (40)..(47): n is a, c, g, or t
  misc_feature (698)..(699): n is a, c, g, or t
  misc_feature (742)..(745): n is a, c, g, or t
  misc_feature (752)..(754): n is a, c, g, or t
  misc_feature (767)..(768): n is a, c, g, or t
  misc_feature (792)..(797): n is a, c, g, or t
  misc_feature (803)..(805): n is a, c, g, or t
  Predicted polypeptide sequence is orthologous to G636
tagagaaaagcagtacagcccatatgtgaccaaaggaggnnnnnnnntctcgtgaaatttagccagtaatgaaaaccctaaatgtcaatgccaactcttttgattgatcattaacaattcaatcgatcattatgtgagcttccatgaaaaccaacctggtcatgaaatcaaattcccaatccccaccagcatgaacactgaatattgatgtacattatatggtacacgttaaacccgtggctactttttcattttgtttgtagtccttacactcgacccatttgcaggccagtttatacgttctcattctgtattggaggatgtagacatgttaaattccggaggatgatcagatgttaacttgtgaaccatagccatgaagcttgaagcatcccttgttgtagaactagaattaggatttgttctctcatggttgtatgcatgaggttctccttgaccactaggcatgacagccaagatatctgctccatgatcaccttgttggttgtgggaatgatgagcatgagtattttctctgttacttccactgggctgttcatgctctaccagctcctcagtctcctgatcctccaccttctgatcattgccattaaccattgaatccttctccataattttgttctgcctgttggccagatttctcttcttgtacaaagcatccaactggtgaaagtaannacaggtcttggcattttcaggacgcttcttgttactctctttnnnnttcctgnnntacttgttgatgnntttcccacttctccttacatctcnnnnnnctgcgnnngt

SEQ ID NO: 17068 - DNA, 638 bp, Picea glauca
  Predicted polypeptide sequence is orthologous to G651
tttttttttttttttttaattgaaaaacaaattgatgatttgctattagagaagaatgaattaaatttttgtaactcatacaaatatgtagaatgaatgccaccagtatatctagattctgttgacatccattgaactacatgaatgggaaagaaccaacgaaatccttgttcaagcgcacgtctaatttactgttgtaatcaagggcaaaccagctcgtttgcagcccagatctcggcccctaacaaatccagtgttgctcctgaattgactatctgcttcatcctctttaaccacaccaggctgatggctctccatccaccaaggttgagaggatttataagatatgagtttgtagtcataaggaggccaattagtagaatccaagaagtccccacctaaattgacagaaactgcagaactatgctgcacttgaatgcagtcattttcatcttcagcaggcatgttcagatccaactcttgggtacttttaatagctgaaaggtgctgctgctcgatgttggaaaggcttgtagaggtgtttgtactagtagcagggggagtggagtgagtcctcttgtgaccgcccaaagcttgcccagatgtaaaattcctgtgacacacagggcattcgtgca

SEQ ID NO: 17069 - DNA, 853 bp, Picea glauca
  misc_feature (10)..(13): n is a, c, g, or t
  misc_feature (34)..(39): n is a, c, g, or t
  misc_feature (766)..(766): n is a, c, g, or t
  misc_feature (802)..(808): n is a, c, g, or t
  misc_feature (812)..(815): n is a, c, g, or t
  misc_feature (826)..(826): n is a, c, g, or t
  misc_feature (828)..(828): n is a, c, g, or t
  misc_feature (830)..(831): n is a, c, g, or t
  misc_feature (833)..(833): n is a, c, g, or t
  misc_feature (842)..(848): n is a, c, g, or t
  Predicted polypeptide sequence is orthologous to G652, G1335
cgaaacttcnnnnagttcaaaataaagtagtatnnnnnngacaaaaaccattcacagcgggagtgccgttacacatgatataactttaatcaccgcctcacagtaaaaaaaggagtgtttatccctagccaatagtagcaaaaatagatcgtctaccgccaatttatggcctgactcgtagagagtctacagataaatagttcaagtaccttacattacaatagaaccatacaaacataactaagcctgctaatttcaaaacaagataaaacatttaagccagacataccaaaatcggagcaggcttacaacgacaaaagccacaaaccacgaaatcttagagaaggcgtgagtagcggcagcgggcacaacattcaaaacgctgaaggataacaggaataagcaggaagagaaggcttccgaaatgcctaaccttcacggttagggcagtctcgggcaaagtgaccaaagtcaccacactgataacagctgccgccgcctgcgccgccgccgccaccaccgttgccaccaccgccgccaccgctagtgcagtctctggcaaagtgaccagattctcctggacgaacgctccatcaggccccgtaacatctagggccttggttcttccgccattctcatgctcgaccgtgtattcgacggcctctccctcagccagcgatcgaaacccgttggaatgaatcgaagtctgatgtacaaacaggtcctcgctgccatcatcaggggttatgaaaccataacccttagncgaatcgaaccatttcaccttgccagatctctttcnnnnnnncatnnnncgaatccctcnangnncnaccaacaannnnnnntcgtg

SEQ ID NO: 17070 - DNA, 925 bp, Picea glauca
  Predicted polypeptide sequence is orthologous to G653
ttttttttttttttttttactttggaaacttttgcaaaccataataataaatactgccaatatcggctaaacagagttagcttccttttacaaacgaatataaattaaactacaagacattataccgcaatgtccctcacttagggttggcaaatacaattggtgaaattccaaagagaggatcaggtctcttttccccaacaaactagcataccgtgtaaactcttcaaaatacaaacacaaatgataatcaagtaactagatcacaataacgttatatctcagggactgcacttgctacctcagggactgcagctgctcgtttcattgtagcggtcttgatgagatgattgtaacttcccttttccttgaagagctgggaaaaatgatgcttgcaatacagtatgccttctagtgcagcataattagaagggctgattgaacaccccccatgagaacacttgaaacaagacttgtggtaggataagctttccacagtgaccttctcaagagggtatgctgtttttccacaggtagcacatttgtcttgagttccagagaacatcatggacactttactaggagatcttgtcagttcaggtgaaagtccatcaattactttgcttgatctttgggactgaaagttcttgttaaagttgccgctctctctgaaaagctggtcaaagtgaggcttgcaatatagcactccctccattgacgagtaattactcagcttgagcgtccccttgcaatggttacatctgaagcaagacttgtggtaagaaactccatccgcggacagttgatccacaaaataaaccgttttatcacaagctttgcacttctgctgcgttccggtgaaggccatagccacgatccgataatttttattgtaaaaatacggtcttgagccctcgcgttctaa

SEQ ID NO: 17071 - DNA, 652 bp, Picea glauca
  Predicted polypeptide sequence is orthologous to G663
ttttttttttttttttttggacgggtatttcctgattataaccgactggcttatgaacaaaagcggcttcttcaacctcattgtaaatgctatttgcagaggaaataataatagcagtggaggaagaagagatgatgagatcatcataacagacaacaatcacattttcagtatcaaacatacaagaatgtggacgggcatttcctgattagaaccgactgccttatgaacaaaagcggtaagggattcgatcaacttcatctccgccgatacagtacctgaatctgaacaagggcttggattttgtttcgtagaagatattagggttttgcccttgttcatagaattggaagatgtcgatcccttcttcagctcctcgtaatacagcaagcaataacttcgtctctttcacccaactggttgggtagcttcgtgcctttcacccaactggttgggatttagtggtcgagtcatacttacagccgtattacgctctgtcggtctaacgaacttcaatctgccaatgcacgcattggcatgagttttcttgctcaaacgagtattcaagcagttcttgataccgttatcggtgccctcaattagtgaccaccagttttccagcagtttatgaagtcttattataagctcttct

SEQ ID NO: 17072 - DNA, 893 bp, Picea glauca
  misc_feature (845)..(849): n is a, c, g, or t
  misc_feature (869)..(883): n is a, c, g, or t
  misc_feature (892)..(892): n is a, c, g, or t
  Predicted polypeptide sequence is orthologous to G715, G1646
cacaaccaccaccaacatcatccatcttcttcttccggcggagcagcgccgcaaggcatgtctcagggctatcctggcggagcagctgctccccctacgcctgtgggcatgcagggacaggcggggcagcagccacagcctggtctccaccagagcggcgcgcagcaggccttccaccaccaccacatgcagcagcagcagcaacagctccaaatgttctgggctttccaaatgcaagagatcgagcaggtgagcgacttcaagaatcaccagcttcccctcgcccgaatcaagaaaatcatgaaggccgacgaggatgtccgcatgatatcggcggaggcccccgttctgttcgcgaaggcctgcgagatgttcattctggagctcaccatgcgttcatggattcacgccgaggaaaacaaacggagaacgttgcagaagaacgacattgccgctgccattaccagaactgacatattcgatttcctggtggacattgtgcccagggacgacctcaaggaagagggtttgggtttagggtttgccagaggtggcgtgacccccgagggttcattctattaccctcctccttccatgccccaatcgccacatcaacagggaatgatgggcccctcttccataatgatgggcaggcctgctccacttcagatggacccatccgccatgtatatgcagcagcagcagccaccccgtccctatggtatgcctcctcatcctcaccagcccatgtggcagcaccctcatcatcctcacccacaccaacaacaaatgcccgacggacaaagttatggacatccacatcagcagcagcagcacttgccggnnnnncagtcttatgggcaacatcnnnnnnnnnnnnnnnattcttatng

SEQ ID NO: 17073 - DNA, 835 bp, Picea glauca
  misc_feature (790)..(792): n is a, c, g, or t
  misc_feature (799)..(808): n is a, c, g, or t
  misc_feature (819)..(825): n is a, c, g, or t
  misc_feature (828)..(834): n is a, c, g, or t
  Predicted polypeptide sequence is orthologous to G715, G1646
cttccgtttctcatggaccatcgagcttgatgcataattcgatcttccaacagcagcagccacagatgcctatgcaacatcatcagcagcagctacaggggtcaatgcagcctcatctccattacatgcagatccagaaacagcagctgcagatgttttggcaacagcagatgcaagagatggaacaaattgcagagtttaagcagcatcaacttcctcttgccagaattaagaaaataatgaaatctgatgaagatgttaagatgataagtgctgaagcccctgtcctattctcaaaggcatgcgagcttttcattttggagcttacattacgttcatggttacatactgaagagaacaaaagacgtactttgcagagaaatgacattgcaggagctataagcaggggtgatgttcttgattttcttcttgatattgttcctagagatgaagtcaaggatgaggaatatgggggacactggcctgggattcctcatgcagaatctatgtcttatggagggatacactttccactcatgcatgctcagccttaccaccacaatcttaatcctgatgtgatgactgctcaacaaacaatgtctcagcaattaatgtctcagcagcctttaatgccagaccagcagttgatgtaccaacctccacagcaatgatcataaggttggatggaagccagagtatcaatcaagaatgatcaggctgattgctctcgagcctagatagcatcctcagaacagccatattttctcaaaaacagcatttgattatgagnnncagcttnnnnnnnnnnctttattggtnnnnnnnttnnnnnnna

SEQ ID NO: 17074 - DNA, 633 bp, Picea glauca
  Predicted polypeptide sequence is orthologous to G732
ttttttttttttttttttctttgaatatacaatgccccttaaataatccatgacatggtttacaatacccctaatatgactccaccgaatttaagctgtttttacatttgccaaataccactcaaccatttaatcaaaacccattttgtccatgaaaggagaaagcagatacaactgaaacctaataagataaacacaagggagtattcacaacgtacacattgaatttgggcctcagaacaagagatcggaagagataaaggaattagcaatggtgcctgattccaagcttagatgtgcagcactgcaattcccagtttcaatacccgtagttttaaagccaccatgtgattgggcatttatcgtgtgctgtaatatctggagctttcgactcagctcctgtgcctgcgatctcaagaggcaattctcttctatgatatgagcataatgccgtgaagcaatattgaatttgtctactatctctccgttctctgttctcagaagagccacctgcgccctcaactcgtccaagtgatgttgtttccggagcctggaccttcttgctgattctctgttagacaacatccttctctgcttcctcacgtctatcacttgctgaacctctgcttcatc

SEQ ID NO: 17075 - DNA, 835 bp, Picea glauca
  misc_feature (756)..(760): n is a, c, g, or t
  misc_feature (786)..(790): n is a, c, g, or t
  misc_feature (820)..(825): n is a, c, g, or t
  misc_feature (827)..(833): n is a, c, g, or t
  Predicted polypeptide sequence is orthologous to G732
ataagctttgcagtaggatgtctcctcccccttcgtattccatgtttcccaattcaggaatgggcttaaatccctcagtgacatcttcagaaccctctagtcaggtctccggatcgatcccccatcattattcaggctccgaggaagacccaaaacagacgattgatgaaagaaagcagaagagaatgctttccaacagagaatctgcaaggaggtccaggatgagaaagcaacagcacttggatgaattgagagccgaagcagctcatctcagagcagagaacaatcatatgctgacaaaattcaacattgcttcacacaaatacatgcaactggaagaagagaattctcttctgaggtcctatgccacggacttgagcctcaagctgcaatccctgactattgcaatgcagtgggctggagtgctgaatgatatggatctggatagtagcactggctttatggatacaacggatatcaagtcttgttacttgccttccatttcacagcccttgacatcaacagaaatttatcaatagctactcatgtgtctcgaacatatcaattagcacattactcttatctgccaatctgtatagttttagaatttgttgttataagcgaagaatggatctgagaaagtgaggaatgatcctatcaggcaacatgatgaccacattgcttgtttgcaagcttgctgtgatgtaagatagtgtaggatggatggagaaagaactagttataattcattctttnnnnngtattgagccctgcacagatttattnnnnngtctttgtctgatgtaataatctgcatttnnnnnncnnnnnnngt

SEQ ID NO: 17076 - DNA, 577 bp, Picea glauca
  misc_feature (72)..(74): n is a, c, g, or t
  misc_feature (298)..(300): n is a, c, g, or t
  misc_feature (510)..(512): n is a, c, g, or t
  misc_feature (539)..(545): n is a, c, g, or t
  misc_feature (554)..(555): n is a, c, g, or t
  misc_feature (569)..(572): n is a, c, g, or t
  Predicted polypeptide sequence is orthologous to G735
ttacaacccgtatatgtaatgacttctctaaatttcatttgtaatttacacatgcagctttgttgtttctcnnnatcaatgaatgtaaacttgtcaagaaaataattatagtgcattgttgtgcgagtccaaaatgatgtactgtacaactagagcaggccaaatggattttcaaatctaactttgccatttttcttctataatagtctgtagcccgatggcatgttgacctttacaccccacattggatggaaatgtaaagataattctgggaacttctactgctgctgaaagattnnntgaccagtaacttactgtccaccattctcaatcctaggtgagccttcaatatcccagcctccactccatggcgtggatccacaggtcactcccccacgaattcgcttctgtaaatgttctaaactcgcaacccgttgcatagagggtgtccgccccattttggttccaacattctgtgttaatagctctttattccgatcattcatattnnnaatatcgcaaggcattccttgagttgnnnnnnnctgtccagnntgtgagtatcgacnnnnatcct

SEQ ID NO: 17077 - DNA, 803 bp, Picea glauca
  misc_feature (4)..(5): n is a, c, g, or t
  misc_feature (689)..(690): n is a, c, g, or t
  misc_feature (729)..(730): n is a, c, g, or t
  misc_feature (778)..(779): n is a, c, g, or t
  misc_feature (789)..(795): n is a, c, g, or t
  misc_feature (797)..(798): n is a, c, g, or t
  misc_feature (802)..(802): n is a, c, g, or t
  Predicted polypeptide sequence is orthologous to G752
ctgnnagcggttgccctgttgcagaggtgtcatccattgccaggagtcgccaattacagagatcaaggcgttcgtctggagggggcctaggagagatactttctgcactggagcgatctgagggacgtgatgaattgagttatgagcaacttttgatgctggaagccactctcctgttgggtggaatagacatttacgaccagcacaggaattggcggcttgacgtagacagcatgtcctatgaggacttacttgaacttggagatcgaattggttacgtcaatacagggttaagtgaagacactatttttcagtgcctacaaaagatgaagcattgtatcatggaagctatatctacttgtctaacagaaaatgagcggaagtgtagtatttgtcaggaggaatatgaacctaatgatgagttggggaaacttcaatgtggtcatagctatcatgtttgttgcataagacaatggcttcttcagaaaaatgcatgtcctgtttgtaaggcatctgcgttgtcgtagcaatgccatattggtaattctcttttggtttgttggcgtggtattttagtatctgaagagcatattgtatagatttagcatgagacggattttatttttagatattcattcgccatcatttggtgttattccatatatatcatgaacagagcgattggaatnntaagaaagctatgtgtttgaggacagctcatgagtacgnntgactaaatgtaaaagttggtggtgggaatttttctttttcaaaaaannaaaaaaaaannnnnnnanngggng

SEQ ID NO: 17078 - DNA, 829 bp, Picea glauca
  misc_feature (8)..(18): n is a, c, g, or t
  misc_feature (57)..(57): n is a, c, g, or t
  misc_feature (96)..(100): n is a, c, g, or t
  misc_feature (793)..(800): n is a, c, g, or t
  Predicted polypeptide sequence is orthologous to G773, G1412
ctgcaggnnnnnnnnnnnaggaaaggaagcatcaggttggacgactgggtactgtgncgaatatatgaaaagcactacgccagtcagaaggccgtnnnnnaagaaagcaatgagttatcatcatgcgtagatccagaagaagatcaatatatggcacccgttgcatcgacatcccctccagacatggacgataacaagctgctcatcaatctgccgcgaatcaattccctgaacagaataaactctcttctgaaattccccagcagggagatcatgaagatgccagacccgaactacaaccagacggagcaacaatattcgcgtgcagaaacagatgccggttctaattccggaggccaggcgatagaatatggtcagaattcaccgttctggagaaaccagcaattcggatacaactatgatcagatggcgcagaacccgtttcctcaacagttagagcatatgccatccttgggagccaattctagtgcgttttttgcaagcctggctgcagagctcctttagagataattcattcattctgctctgctctgctctgaattacccatggagcttttgcaattggcaacggatgcggccaacactggcaattctaacttgattcaatctcttcctcccctgcaataacgtgcacgggccacggattccggctgcttaaattttatattccggccttattatctactttttgtacgcttgttacttattgtatgctcatgatccattttctggcatgggatccttcgctctgtattgtacagttaaaaatatnnnnnnnngtatttctaagtggatctgaagttttgta

SEQ ID NO: 17079 - DNA, 477 bp, Picea glauca
  Predicted polypeptide sequence is orthologous to G805
ttttttttttttttttttcttcttttatgcatgatccatacccccatggggggaatggtaataaaatgagctagcatgagatctctgttatgtaaaaggctcagctccccaagacttgatcatcagtgcatactctagagtgttttttttcacttgttaattatatcttgttcttcagcgagttataatttctaagttttttcactcacaacctccaaagttggagtgtgtactaatggttaggacttagtgtgtattgtttgagtatagtgtctaatgtctattaccatgttgatcatttatatagtcttatggacatgcactaggtccctccaggattttttaattattttaataagtaaaataggatttttactttgtaatttgatgtaataataaaaaagtagtactaggaggcattatatgccttgggggtgtcattttctaagccagcctcgtgccgaattcggcacgagg

SEQ ID NO: 17080 - DNA, 392 bp, Picea glauca
  Predicted polypeptide sequence is orthologous to G807
ttttttttttttttttttggttaagaactagtcttttttagatgtaaggaaatacattaacagctccaaacccagagggatctggcaggaatgaaagtttgttccccttacaaaccaccaggggatcatttcaggtggagtggttttccttgaataatggtaatgaatcagtctacattcgcaaaaggcagccagtgatggttgtcttcactgctagttgaccactgagttatgataggtttttccacctttaaaaaaatatatatttctgcttacaaaaactactaaagttgtttctttgcacatatctaggactgccaagtttctctagttctttctaaacttccaatgatgtcaatcatgtcgggtcgtttttgtggggactcttgtgc

SEQ ID NO: 17081 - DNA, 892 bp, Picea glauca
  misc_feature (781)..(784): n is a, c, g, or t
  misc_feature (829)..(833): n is a, c, g, or t
  misc_feature (835)..(835): n is a, c, g, or t
  misc_feature (841)..(859): n is a, c, g, or t
  misc_feature (870)..(875): n is a, c, g, or t
  Predicted polypeptide sequence is orthologous to G839, G1196
gttaaattgctattgcaagagggggtgggccagataacattggatgatgctcatgccttgcactatgctgcagcatactgtgatccaaagatcacatcagagctgttggagcttggatgtgcagatgttaatctcaaaaacccaagaggatacactgtccttcacatggcagcaatgcgcagggagcctgcaacaattgtggcactcttgacaaaaggagctcacccttctgatttgacttctgatgggcgaacagcacttcagatctctaagaggctaactagatctatagattactttcgacccacagacgaaggcaaggaatctcccaaggacagactatgcattgagatactggagcaggcagaaagtaggaatccgctaagggctgaggtgcccctttctcttgcttttgcaggtgaggatctgcggacgaaattgctcgatcttgaaaacagagttgccttggcaaagatcctgtttcctacggaagcaaaattagctatggagattgcacatgtggatgcaacttcagagtacactgtggatctaaatgagacacctactgctgtgatgactaagaaactcttatctaggatgaaagctctgtcaagaactgttgagttaggaaagcatttcttccctaggtgctcggaggtcttaaataaaattatggatgatgacttgccagtaatcactttggaagaacaaagagtaaaacgtaagcggtatgatgagctcaagagtgttgtatcagaagcattcagcaaggataaagcannnnatgagaagtcgggtatgtcctcttcatcatcttcatcatctgtannnnntnggctgnnnnnnnnnnnnnnnnnnnatcggtagacnnnnnnccttttacagtgatcta

SEQ ID NO: 17082 - DNA, 596 bp, Picea glauca
  Predicted polypeptide sequence is orthologous to G846
ttttttttttttttttttgttttataccttctcgcgctttgttctctacctttctctaagggagacagaaataactcttccttatcatctttacaaacggattgttctttacaaccggattgttcttctatttctgggcatcacacttcttcacccttagggtttacacttctgcgtaatatttgtcagatggtgcacaagtatagcgggtctttgacatttgtctgctctgtccaggttaaggtttcttccgctgcctacgtattccttccgcgtggttagaggctctgcatctgaagggtttccggcctctgtcagatggtatcagagcgtcagggctgggtgtgactccctcacgggagtgcccaggcacatgaggagagtagaggcgtgtgtttgacttataggagctgccgtctagagcgtggagtgctgcgtactcatctcgtccagtgttatttgtagtgctgcgtgttgtgtgaaaagatcgactgtgaaagggccaactgtatcatctggagcgatttgttgtcttgtggcgtcgatgaaactgcgtggagcgattgttgtaatgtttggaaatatctcaaccgatc

SEQ ID NO: 17083 - DNA, 802 bp, Picea glauca
  misc_feature (26)..(28): n is a, c, g, or t
  misc_feature (48)..(50): n is a, c, g, or t
  misc_feature (53)..(55): n is a, c, g, or t
  misc_feature (60)..(62): n is a, c, g, or t
  misc_feature (139)..(141): n is a, c, g, or t
  misc_feature (162)..(162): n is a, c, g, or t
  misc_feature (209)..(209): n is a, c, g, or t
  misc_feature (694)..(694): n is a, c, g, or t
  misc_feature (698)..(698): n is a, c, g, or t
  misc_feature (719)..(720): n is a, c, g, or t
  misc_feature (723)..(724): n is a, c, g, or t
  misc_feature (736)..(736): n is a, c, g, or t
  misc_feature (756)..(756): n is a, c, g, or t
  misc_feature (763)..(768): n is a, c, g, or t
  misc_feature (787)..(787): n is a, c, g, or t
  Predicted polypeptide sequence is orthologous to G852, G2633
gctaagcaactttctccatacatacnnntctatcgatgaaatatgacnnncannnttaannnttttcaataagttagcccaagtcacatgagaaatacttaccttcgctaggagaggctatgttaacacattacttccnnncagaagccacaaacaagtccntgcctaaccaacccagataaagaacttcatccttttctaccaccctntaattctgattataagactccaaggcaaccttgatagtggagttaacacgtgagctcagagcgtgagatttaaagccagccatagtaaaacgggacctccacttaccaaaaggctcgtgcctttccactctttcagcaccttcacatgcaataacattcacaatatcacgtgctagacagtgctgctccacactgacacgctctttgctttcccttggcagagttaaatccaaagattcaaacatagcagtataataactcaaagtctccaagaatcttggaaagaaacgagaagtattagtattagattcttgctccaccaatgttacaacagttggagccaagcctttgaccattcttataagccgatctcgatggttacttgtactcacactctcatcaggtatatgatggagcaataaatgaaaatttacagccaatgcttccccagatcgaatatcaagcatatcggcatgaacgtcagntgcnaacacaggcaaagcatgaaanncgnnaggaacctgatnagtttcagcaagctttgatnatctttnnnnnnccaactgtaatccttgacntcgagcaaactctga

SEQ ID NO: 17084 - DNA, 880 bp, Picea glauca
  misc_feature (4)..(5): n is a, c, g, or t
  misc_feature (9)..(10): n is a, c, g, or t
  misc_feature (12)..(17): n is a, c, g, or t
  misc_feature (823)..(823): n is a, c, g, or t
  misc_feature (825)..(825): n is a, c, g, or t
  misc_feature (847)..(859): n is a, c, g, or t
  misc_feature (866)..(868): n is a, c, g, or t
  misc_feature (871)..(877): n is a, c, g, or t
  Predicted polypeptide sequence is orthologous to G852, G2633
tatnntttnnannnnnncctttaggctgacacaagatcttctgaagtcctcttctgagcatgtattgacagagtgtctgccacataccataaaatacaaatctttgaagtcataacagaaagacaaagtatccattaaagctaattctgtatataattatctggctctatgcatcatttgcatcttccacatagttatgagttagtaaatcatcagttgactataaatatcggcctcatgtcttcctgaaatgagtgcaggctgcaccaacaactcaaattggcaaacatttgaatagaatagcaaattttgtcacggtattgttgagggtgggttcaacaagtcctcgctaacagctttcgttacctgcatctgagaagagataaagagcacacacctctattgttcagacacagtaaagtaagggcctaagttgcacaaatgcataatatacttgagatgggaaggatgtgttaaaccgtttgaatctcatcatgttggtctatgtctgtgttattttatcatggaatgtgattctaaattccaagctgataccacgacgagaactttatctagccatccaaagtgcagagcccccttttctgcctttagactgtagttattgccacgggactcgaacagaggccgaacactattctcaacagttgtgttaatgggatatatggtaaagccagccattgtcattctggccctccattttcccgctacttcatacctctcaatcctttctgctccctcacatgcaacaatgtttactatgtcccgtgcaaggcactgcttctcgatgttgatccggtctcgntnttccctttggaggctaatatcnnnnnnnnnnnnnacggctnnntannnnnnnagt

SEQ ID NO: 17085 - DNA, 840 bp, Picea glauca
  misc_feature (795)..(797): n is a, c, g, or t
  misc_feature (821)..(823): n is a, c, g, or t
  misc_feature (831)..(837): n is a, c, g, or t
  Predicted polypeptide sequence is orthologous to G852, G2633
agcggccagcgaatttcaagatttcagaggaaatagcaactgcactgttgaggactaatagtgacgatccttcaaatatggaagatgtctatggggatcataaccttccatctaattcagagtggagtccagagtcggagatccctcaaggtgatataaaatgtttgctcattgaatgtgcgaaagctattgcagataatcgtaatgcagataagttgattgccaagttgagacaagctgtttctatatttggggatccaattgaaaggttaggcgcatatatggtagaaggtcttgtagcaaagttacagttttcaggaggacatatttacaaaaccttaaaatgcaaggagcctacgagtgctgagctactctcttacatgcaagttttctacaaagtttgcccttatttcaaatttgggtatatggctgcaaatggtgccattgtagaagcatttaatgacaaagacagagtgcacataattgattttcagattgctcaaggtagccagtgggtaacagtgattcaagcatttgcagcaagacaaggtggctcacctcatgttcgcattactggtgtggatgatcctgtatcagagtttgctcgaggtcaaggattacagttggttggccaaagattatcaaagcttgctgaaacttatcaggttcctttcgaatttcatgctttgcctgtgtttgcatctgacgttcatgccgatatgcttgatattcgatctggggaagcattggctgtaaattttcatttattgctccatcatatacctgatgagagtnnnagtacaagtaaccatcgagatcgnnntataagannnnnnnaag

SEQ ID NO: 17086 - DNA, 859 bp, Picea glauca
  misc_feature (687)..(689): n is a, c, g, or t
  misc_feature (759)..(759): n is a, c, g, or t
  misc_feature (787)..(796): n is a, c, g, or t
  misc_feature (810)..(820): n is a, c, g, or t
  misc_feature (844)..(848): n is a, c, g, or t
  misc_feature (855)..(857): n is a, c, g, or t
  Predicted polypeptide sequence is orthologous to G852, G2633
cctttcgaatttcatgctttgtctgtgtttggatctgatgtttatgctgatatgcttgatattcgggccggggaagctttggctgtaaattttcctttacagctccatcatatgcctgatgagagtgtgactacaagtaaccatcgagatcggcttttaagaatggtcaaaggcttggctccaaacgtggtaacattggtggagcaagaagctaatactaatactgcacctttctttcccaggttcatggagactttgagttattacactgctatgtttgaatcattggatgtaactctgccaagggatagcaaagagcgtgtcagcgtggaacagcactgtctagcacgtgatatagtgaatgttattgcctgtgaaggtgccgaaagagtggaaaggcatgagctttttggtaagtggaggtctcgtctgactatggctggttttaaatcttaccctctgagcgcacatgttaactccactatcaaggttgtcttgaactcctataatcagaattataggttggtagaaaaggatgaagctctttatctgggctggttagacagggacttgatcgtggcttcagcatggaagtaataatgtgttaaacatagcctctcctagtgaaggaaagtatttgtttatgacttgggctaacttattgaaaacatttagcagtacatgtcnnntttcatcgataggacctgtatgaatggagatagtcgcttagtcacaaggttatcgaagctggtatagctnaattcaaaatctgaaagtaaagttattnnnnnnnnnntggtatttgggaannnnnnnnnnnaaaagcaaaggattgcggacttgnnnnntttattnnnag

SEQ ID NO: 17087 - DNA, 868 bp, Picea glauca
  misc_feature (791)..(791): n is a, c, g, or t
  misc_feature (795)..(802): n is a, c, g, or t
  misc_feature (806)..(809): n is a, c, g, or t
  misc_feature (815)..(816): n is a, c, g, or t
  misc_feature (820)..(826): n is a, c, g, or t
  misc_feature (830)..(830): n is a, c, g, or t
  misc_feature (832)..(832): n is a, c, g, or t
  misc_feature (843)..(843): n is a, c, g, or t
  misc_feature (847)..(847): n is a, c, g, or t
  misc_feature (856)..(863): n is a, c, g, or t
  Predicted polypeptide sequence is orthologous to G861, G1140
acagtgtgagaaaacaactcaatataatttaatcaattatataatatattcactttttctttctattattttttataggaagaaaactattaaaatagaaatatgaagcagctcttgaaatttgatcacggaagatcacgatgcaacattctcaaagttcagagtgcgaagataaccctagctgcaaggaagtaacagaatcctcagggtctttgacaggagagttatgtaatttgaaattaaacgcatatgtatttatagattcagatgactggggatcctgattttccaatggctcaatgaacaaagattcgcatccatcgttattttccacaagactgccatatccttcatttagctgtccacggagttttgtattgtcctctatcatttgtattcccttttgttgaagttcttttatctccttaacatgatgctcaaccttttgtgatcgaatgcttgtcaatcccatttcaagttcttcttctagttgttgcaagtcttttaaagataacccttcaagttccttcccatgcatttttctcaaattccgactagtatcttcaaattgttgttttatccttttaagatctttactcttgaactcaagagttgttggttgtccatcattttgaattgtgctatgatacaaaatgtatttgtccaatatcaccttcatactggagctcgagtagtcgtacagcttcccagttgaagaaaaaacgaccagggctacatcagcttcacatagaatcgatagctcccgagcttttttgaacagccccctacgnctcnnnnnnnncgtnnnntgcctnntcgnnnnnnnagcncntcttttaattnctanttgctcgcnnnnnnnntcact

SEQ ID NO: 17088 - DNA, 897 bp, Picea glauca
  misc_feature (818)..(823): n is a, c, g, or t
  misc_feature (825)..(825): n is a, c, g, or t
  misc_feature (829)..(829): n is a, c, g, or t
  misc_feature (836)..(842): n is a, c, g, or t
  misc_feature (845)..(851): n is a, c, g, or t
  misc_feature (857)..(857): n is a, c, g, or t
  misc_feature (877)..(878): n is a, c, g, or t
  misc_feature (885)..(887): n is a, c, g, or t
  misc_feature (889)..(895): n is a, c, g, or t
  Predicted polypeptide sequence is orthologous to G861, G1140
tagaaattaagagaatagctaacgcttcggccaggcaggtcacgttctcgaagaggcgcagggggttgttcaaaaaagctcaagagttatcgattctatgtgaagcagatgtagccctcgtcgttttttcttcgactgggaagctgtacgactactcgagctccagcatgaagatgatgctggacaagtatattttatacccaagctcaaatcggaaggatggacaaccaaatcttgagattgagagtcatgatctcaaaaggataaaacaacaaattgaagatattagtcaaactctgagaaatatacatggcgaggaacttgaaaaattatctctaaaagacttgcaacaactagaagaacaacttgaagccgggttaagtaaggttcgatcacaaaagggtgaaaatattcttaaggagataaatgagcttcaacaaaagggaatacgaataatagaggagaattcgaaactgcgtcgagagatcaaggaagcagaacgcggccatgtggaaaataatgatacagaggagtctttcttcattgaaccatcggaaaatcaggatccccagtcatctgaatctataactaatgcttttactttcaaattacataaatcggccatcaaagactatgaggattctgatacttccttgcagctggggttatcttcgcagtcaaaattttgagacgcttgcaaacgtcatcgtctgtgatcaactttcaaacactgcttcatatttctatttttacaattttctgatattttaacaattttcaaacaaattcgatcagggaaaaattaagcatggacgatnnnnnnangagntaccatnnnnnnntannnnnnnagatanacgaacgagtaacacaggtnntagacgnnntnnnnnnntc

SEQ ID NO: 17089 - DNA, 841 bp, Picea glauca
  misc_feature (801)..(802): n is a, c, g, or t
  Predicted polypeptide sequence is orthologous to G861, G1140
gctaatcgagagagatcttgcctgttgttgtaatctcagattggaatgacatggcccgagagaaaatagagatgaagagaatagctaacgcttcggcgaggcagatgacgttctcgaagaggcggagggggttgttcaaaaaagctgaggagctatcgattctatgtgcagcagatgtagccctcgtcgttttttcttccactgggaagctgtacaactactcgagctccagtatggaggtgatattggacaagtacgttttgtatccgagcacaattcaaaaggatggacaacaaattctcgagttcgagagtcaagatcccaaaaggataaaacaacaatttgaagatgctagtcaagatttgagggaggaacttgaaggattaactttaaaagatttagaaaaactagaagaacaatttgaaatggagttgagttgtattcgatcacaaaagatgtcatttttgtggtgttgtaaggtggaacatctttctaagaagataaatgagcttcaacaaaaggtaatacaaatgatagaggagaatacaaaactccgtggacagctaaatgaaggagatggcagtcttgtggaaaataatgatggatgctaatctttcttcattcagtcattggaaaatcagaccccccgtcatctgaatctataactacttatgcctatcaaagactgatgattatgttacttccttgcagctagggtatgcaattatacttatcaaattctgtttttatttatttttaattggtgttatcttaacattttatgttatggtatttttttgnntaaatttgattatataaatttggacgaaattttattttt

SEQ ID NO: 17090 - DNA, 840 bp, Picea glauca
  misc_feature (768)..(774): n is a, c, g, or t
  misc_feature (809)..(813): n is a, c, g, or t
  misc_feature (815)..(816): n is a, c, g, or t
  misc_feature (819)..(837): n is a, c, g, or t
  Predicted polypeptide sequence is orthologous to G896
ctcatgctcattgaagagcaaagtgatcctcttagaataccaacagcacacaatatgcgaatggctctatattggcttgtgcaaggttgtcagcctggagattcattagtgttccattactctggacatggttcacaacaaaggaataacactggagatgaagttgatggatttgatgaaactcttcttcctctcgactttgaaacacagggaatgattgttgatgatgaaatcaatgcaagaattgtcagacctcttcctcgtggtgttagacttcatgcaataattgatgcctgccatagtggcacagtattagatttgccttttctatgccgactaaacaggagtggacagtatgtttgggaggatcaccgtccacgatcaggtacatggaaaggaacaagtggtggagaagccatctccttcagtggatgtgacgataaccaaacttctgcagatacttcggctctctcaaggatcacatcgactggagccatgacatactgttttattcaagcaattgagaagggagctggaacaacttatggaagtctattgaattcgatgcgtaataccatccgtgaaacaggggcaggcactggtggtggtcctgtcacttctctcataactatgcttttaactggaggcagctacagtggtgggcttacccaggagcctcagctgacatctacagaaccttttgaaatccatactaaaccattttacctttgatggtaagctgaatacatggtgaaatgtagcttgtgnnnnnnntctgtttagtgcttccttcttttatgttcaatgannnnnannggnnnnnnnnnnnnnnnnnnnctc

SEQ ID NO: 17091 - DNA, 602 bp, Picea glauca
  Predicted polypeptide sequence is orthologous to G911, G1113
tttttttttttttttttaacaccaaaagataagcttccacaacaaagataaaatgtttgtaactcaattttgaccagcctgagagcggaacgaaagtagctgacacaaacagtatttattctatcgactgaattttcccacacacagttatcatgatagatttagattaacgattaacacacttataataattgatactggccttcacctatgctgctatacaaggtgggagacctgcagagaggacaactgtacctttgataatcgatccacttgtccaaacattccatatgaaaaacatgcccacatttaggtaggtaacggattcgatcagttgcccggaaatcagttagacaaacagcacatgtaatatgtttccggcgatctgctagtaaactgccgtattcaacaacggccggcagattctcacggatggtctgtagagggctgttaacggggcagtaagaagaaatatcaggaatggttgtggtgaaaggaactatgggccaaagtgggagagggttacgagaaggatattgacgagcttcttcaagaatcccagttctatgaagagggctcagaatccaattcagtaaacgcct

SEQ ID NO: 17092 - DNA, 554 bp, Picea glauca
  misc_feature (8)..(16): n is a, c, g, or t
  Predicted polypeptide sequence is orthologous to G937
ctcatttnnnnnnnnnatagcaagctattcaatttatttcaatccgaatcattgctctctggcaaatggaatcagaccacacaaatatgagtggctgttatcttacagaaaattatctgataagggtaattgagttctgatttcattgaaaaccctattgagtcttcgtaactcctgcacatgaggctcatcatcttcgactggaacaattttcgcaaactgtccttccccaaagtagtccaccactctgttggcagcttctagtccagtgacatatgccttttcctgagaccaagaaccatgtcgagttataacccaatcaccagccataaataagtttggaatgctagtatttccacgcatcatgtatcgataagaacctattgtaaactatccgttgtagtgcagtgatgccaacagcaaatatgacagcatcagctgtaaatatcttgtctccacaagctactgctgatattgttccagtattctcatccagcagaaaatcggttactcttttatttgcaagaaattgacaacctcgtgttttcatgaac

SEQ ID NO: 17093 - DNA, 567 bp, Picea glauca
  Predicted polypeptide sequence is orthologous to G958
ttttttttttttttttttgcaaaactggtgggggaccttttcttttgacggatcttcagtatagaatgtttgagccagattgccaggaaaggtacagttcttttcacaatatgaatcatttttctcagttggggcagtagactggtcaccactttttatttctaatccatttttcttgacgacacgacataagacaaaagaatcctgtaaacctgctgccccttggcactccttctgatccagccgatactcgtgcataacccaatctgtcctttctcccaatggagcacgacccctgtagaataccagcgtcttttttgttccaattgtgttccgctgagaggtaactttacggtccttacctgttgctttccagtaaccagcttcagtggccctgttagtacgtgagccatttggatacttcctatcacgtggactaaagaaatgccactgtagatctttgcttggaatgcaaattttgtcgggcagatcccatggttcgcatttgtaaaggtccacctcaggaataatgtcaagctcaatcttatggccatgtactttcctctt

SEQ ID NO: 17094 - DNA, 351 bp, Picea glauca
  Predicted polypeptide sequence is orthologous to G958
ttttttttttttttttttaaagaggaaatatatgggctgctattttccactgacacacaaatgtcgagtactcgacagttattcttggggatattgctgaaattacattttgcgtgcccttagatccaacggtgtctaagcactctgcggcggggtgcctagacgttgccttaaagttgagggatttgcaactatttctgatgttgtacagtacttgctctgggtccttccacttttctgctgctacattttatttgtcgccattatttctttaattggtcctctatgcatgtttgcatctgcacatttctgccacgtgacatagaatggttgtgagacttgtgcatctgc

SEQ ID NO: 17095 - DNA, 871 bp, Picea glauca
  misc_feature (780)..(782): n is a, c, g, or t
  misc_feature (784)..(785): n is a, c, g, or t
  misc_feature (787)..(789): n is a, c, g, or t
  misc_feature (839)..(839): n is a, c, g, or t
  misc_feature (841)..(848): n is a, c, g, or t
  misc_feature (854)..(859): n is a, c, g, or t
  misc_feature (861)..(870): n is a, c, g, or t
  Predicted polypeptide sequence is orthologous to G979, G2106, G2131
gaagcccgcattggtagagttttaggcaacaagtacctctacctgggaacattcagcacccaagaagaagcagccacggcctacgacagggcagccatcgaataccgaggtttgaatgctgtaaccaactttgacttgagccgctacatgagctttcttcgtccagcgaaagatttaataaatggcgatggagaagatgttgttgtttccaacgaggactccggaacgagtctcgtccccggtggcgtgtccaccaaatcctcgaacgacgaggacaacatgtcttcgttgctgcagcctcagctttcttggacgcccccccaactcgaatgcagtaacgaagaaaaggaatcgtccagtgcagcggatcccactgacttggaccatctttttgctcagtcgtcctcaaaattcaaggaaataatggaaattagaacttcgggccaccagccgggagaggatttgcacaatatcgaaaccgctaatttcgcagaagatttggagatgttcttcaactccaacaatatgctgggctctgatgcggagttgtctcttaacgtggattctcccagcgccatgaataatatgttcgtccaaccagatcacttgcaccttcaaatgcccttcgacatgcatgagatctgtaacggcgaattccttgatctcgaccaccaccaacacgccgaccttgaatatcccctgatagatcccatttcttcttttcctaattttgtagtcaggacttgttcctgatcaattccagccaataaccacagaagnnngnngnnntagtcatatgtatgcaattaatatgccttgattcctctcttctttgtcantnnnnnnnnagttannnnnngnnnnnnnnnnt

SEQ ID NO: 17096 - DNA, 767 bp, Picea glauca
  misc_feature (4)..(6): n is a, c, g, or t
  misc_feature (51)..(59): n is a, c, g, or t
  misc_feature (735)..(736): n is a, c, g, or t
  misc_feature (746)..(760): n is a, c, g, or t
  Predicted polypeptide sequence is orthologous to G1033
ttcnnnttatgtgcattgtcaacccatagttcacatacaaagcgggacatnnnnnnnnngacaccccgtgccacatcaatacatattagtctcatgttaccactcccccaattacgcatgcttcaaaagattagatacctcatagcatttggctaaacccccccacacatgcacagaggcatccgttacaatattatgcccatgaaaccccacaaaactgttctcttaattaaacaaatccagcaatttctggacacacctactcctcttcagcctcaccatcgccattagaattagcctcttcatcattaacatcaccatcagcatcagattttgctacctcatcctcaccaccatcactggatttagctgcctcatccttgagatcttgttggtatttagacatggctttctcatactctgcctttagttcagcagccttttccaggtatggcttcttgtcctcgtctgacatagccttccatttcaagcccccttccttgccaacctgggcagcacccttgacgtcaggattagtctccttataggtcttcctaaaatcatccatgaaaacaaaaaatgctgtagcaggcttcttcggttgattaggatccctagctttcttctccctcgtgcgctttgtcggcttctcatctgcagactttttctttgcctttttcgcttcgggtggcttctgggcatctgcgtgtttggtttctttggaggcatcaaagnnagaccggatnnnnnnnnnnnnnnngcaatcg

SEQ ID NO: 17097 - DNA, 936 bp, Picea glauca
  misc_feature (779)..(783): n is a, c, g, or t
  misc_feature (887)..(893): n is a, c, g, or t
  misc_feature (898)..(911): n is a, c, g, or t
  misc_feature (926)..(928): n is a, c, g, or t
  misc_feature (931)..(935): n is a, c, g, or t
  Predicted polypeptide sequence is orthologous to G1033
ggggaaaattctctctctcctcgcctcctttgttattatctcaacattgatcggccatttttctatagaggaaaatagcaaagcgagatttgtgtagctgcgtttcgactctgttacagacgaacgttcgaggttccaagcccacgcgttgctaaagcaagtgctttcttcgatgaagggaggcaaagcaaaaaacgaggcgtctagtacgctgaagaaagttgaggagaagcctattggtaagcgaaagactgcagcaaaggaatcgaaggtaagtagtaggcaggagaaaaaagggcgcaaggcggccaaggatcccaacaagccaaagagacctgcgagtgccttctttgtatttatggaggacttcaggaaaacttacaaggaaaagaatcctaatgtcaagtctgtatccgttgttggcaaagctggaggcgacaaatggaaatcaatgtcagaagcggataaggccccatatgttgccaaggctggcaaaaggaaaaccgagtatgaaaagaacatggcagcatacaacaacaaacaaactagcactgcaggtgacagtgctgaagagtcagacaaatctaagtctgaggtaaatgacgaggatgacgaagaaagtggagaggatgatgatgcagagtaaatttctcaaaggcttcgcctgaaatggctttgtatcagtgccattaagttggaagaatttgtaacttgactaattagctgctggtagatgattttgttatttcctaccttttgtagggggcatatatgaaggnnnnntgatcgctggaagtgtatgcctcgggtagttccatatgtgtagttattcatgaacatgttattgactgctgtgatcatgttattaatgtttttaaaacatggtnnnnnnntcgtnnnnnnnnnnnnnnattatacaactttcnnntgnnnnnt

SEQ ID NO: 17098 - DNA, 782 bp, Picea glauca
  misc_feature (44)..(52): n is a, c, g, or t
  misc_feature (745)..(745): n is a, c, g, or t
  misc_feature (755)..(763): n is a, c, g, or t
  misc_feature (768)..(770): n is a, c, g, or t
  misc_feature (778)..(781): n is a, c, g, or t
  Predicted polypeptide sequence is orthologous to G1051, G1052
gggtagcggccctctgctacaaaaaatgtgtctaagcaaaagtnnnnnnnnnacaattccaatacagggctgagagaggtcaaacaaaacacatagaagaaaaaatggtaagaatccttagtccatactccataaccacaagcatcccaaaataaaaacctgcagtagtgttgcactcaagtgttgtgaaccatgtaatcaggagacattcctcccatcattctttcttccaagcacttgttactatcacccataaggcagctcgaagtcatcattcccttcaacatttgagaaccagaactggtatggttgttggcagcattattttctctatggtttgagattcctggaccacttttcataagatttgatgaagaatcagaaacatgatcaggcttttgttctatcatctgtggggatgaattgtgctcaagcttgccaaactgctgctgttgcaagtcaaatgatcctgttgtgggtgctgctacttctttctgcagattttgttgctgctgttcctgatataattgccttagcctctgaacttcctttttcaatgcttcacaatgagcatccttgaaaagtttgtcttgtgcaagggcagcaattctttgttttaagccaccgttgtctacattcaacaggacccgttgatgatccagataggccacttgaggagaaagtgttgacacttctgtctgtaatgcattgacacttctttcgagctctgaaatatattgcaacntccttactcnnnnnnnnngtgcnnnttgtctannnnc

SEQ ID NO: 17099 - DNA, 530 bp, Picea glauca
  Predicted polypeptide sequence is orthologous to G1063, G2143
ttttttttttttttttttttagggttaagggtggtaattagttattaaacgggactgcttacacaagtaaaaagggcccccgatatggattcacaaagacagctgcttaacaatactaaacgttgaaaaccctatttaactggatacattaaaaacaaacttaccaaatctttcatgattttagccctgggggatgactaaaccctaaccccccagatcaaactggagatactaaaaaaaacccaagacccttcccccccccccacaaaagagactaatatttactttctgagtttatagatttaccccgctcctttggaattccctcctttccctttttaagggtgattagcttccagctttttcactttttgctggagcaaccttacatactgaatggcctcgtcaagaacaataaaagggtccatgcaatctcccccgggaattatacttttccggagtttaacaggtcttttaatctttcctttcctcgagttcttggctgatcctgaatgtcccaaaaggcattt

SEQ ID NO: 17100 - DNA, 879 bp, Picea glauca
  misc_feature (12)..(14): n is a, c, g, or t
  misc_feature (49)..(58): n is a, c, g, or t
  misc_feature (782)..(783): n is a, c, g, or t
  misc_feature (789)..(789): n is a, c, g, or t
  misc_feature (791)..(794): n is a, c, g, or t
  misc_feature (797)..(798): n is a, c, g, or t
  misc_feature (839)..(842): n is a, c, g, or t
  misc_feature (849)..(850): n is a, c, g, or t
  misc_feature (866)..(871): n is a, c, g, or t
  misc_feature (877)..(877): n is a, c, g, or t
  Predicted polypeptide sequence is orthologous to G1078
gagtagatctgnnntagataggatctctcgaagtgaaaatactatctannnnnnnnnnactcttactttggagtgaacctaagatagttactgtttgttacaaggattaaatcaaaattgactatcacctatagtgatctagaatgaaacattggcacctagaaaaaggaaagcccttatttctatgatggatggcttcatataataaaaagatttagcaactactttaacatctgacagaagaatgatcattcaaagacttggtcaggttatagatatcctcaaaggaacgcacacaaacacttgaaaaactactcattgcttggaatagacctggaaggcctgtttgaatattatttaaagtcattgctctggttcctctagcggattttgaatagttggccttttcatctgctaaccgccttttatatccctcaatctctgttcttttttctgccaaaggatctgtgggatcccgttcaacttgagactctgatggagaatctgtcctagaaggtagtgaatacgaactataatacttcttttcaatattgcgcagagcaatcattttcttttgcagctctctagaaaggttttctgctttcttcttgcacttttgttcatcagcttgctgcctcactatagcatgaacaacagagataaagcttttgatggactcagaagcaaccttgtctggcagtctttcaagtgcttgttgccattcctcacaaagagtataaataggtgggcggttccctcgatcccactctgcttcattcccnngctgangnnnnctnngacgtgcccacccacacagagcacgaatataatcccgttgnnnntttatcnngctacagaagctgtcnnnnnntgctgnaa

SEQ ID NO: 17101 - DNA, 852 bp, Picea glauca
  misc_feature (2)..(3): n is a, c, g, or t
  misc_feature (15)..(20): n is a, c, g, or t
  misc_feature (44)..(49): n is a, c, g, or t
  misc_feature (740)..(745): n is a, c, g, or t
  misc_feature (769)..(770): n is a, c, g, or t
  misc_feature (780)..(781): n is a, c, g, or t
  misc_feature (783)..(783): n is a, c, g, or t
  misc_feature (806)..(810): n is a, c, g, or t
  misc_feature (823)..(823): n is a, c, g, or t
  misc_feature (825)..(827): n is a, c, g, or t
  Predicted polypeptide sequence is orthologous to G1108, G2394
tnnaagaacatcaannnnnnattttatttagcagcaagacagannnnnnaaatgcaacttagcactcatcacataaaaaaccttggacaacgctaaaagaccactgccaacctatgtgaccaaacttgacaactgacaactacactgcaaacaagcatgttgcatagccaagaagattcatggaaccggcattgcttttgccgaacatgtctaatttgttaaggggggcttcgaagtatatgcattgcccatactctagattattattgagcaagccgaaatgctttggcaatatactcaaacatttatagtataacagccttgctccatttcttcaactgtgcattttcaagcaaaccctatggcttgcccagtatttttgagagatcttctctgtttataatgttagtcagcgactcagcacaactcatgtacagtatgcaacagacaaagttcctctgctttagctaaggtcacaaagattccaacggtagaatttcctaattcacactccctcattacgagaacctctatctctctgttcttctgtttcatgaaaagattcagcttctacttcactagaatcaccaatctcatgcttgcagagaggacaagaagcattaattttcagccatttgtcaacacattctacatggaaatggtgcgtgcaaggaagctccctcagctctacatcatctttgtatttgccaaggcaaatgcaacaaaccgcatcttcagcnnnnnnagatctttcattgtctgtaccagnngctacaaagnnancctcatataaactgtccgagtcnnnnncattgtcatcttnannntcagtgctttcatgttcaacttttc

SEQ ID NO: 17102 - DNA, 790 bp, Picea glauca
  Predicted polypeptide sequence is orthologous to G1134, G2555
ttttttttttttttttttccaaatatgaggttgcataggatttgcctaacagtattacataatgcacatattacatttctgagtaggctcgccgctctaatgccagatcaagacataatatatatacccaatcactctcaagggagagggcctgtgccaagaagaatacatatttgagaacaatactaattatcttttacatcaggtgcttgggaatgtatattcacaataagattatgttttgtatgcacaatctggtttatgtgtgcaggtacacttgtctcgattgtccgtaagttcctggacctgcttctgaagggacttgacatattcaacagcctcatctaacatgtcggcaatatttactgtttgcttgtcactgtttggcacgagttcctgcagttttctcattctttcactgattcgtgtccttcgcaccctttcagcaatgctccgtctctgctgattataattccatcccatctgggacttactctgctgattataattccatcccatctgggacttactctgctgaatttgatagctttagctttttcaagtttgtattagtatggccctaccggagcaccaggaccgcggtctgttcggtctgttcgacaagaagaaggaagaggagggaaagcatgaagacgagacccaaaatgaggctcaggctgaggccgcttcttattatccaactcctcctcagcatggagtagagcactgccagggtcacggtcacgaggggcaacttacgcctgaggaagctgagcaaaataaacacgcg

SEQ ID NO: 17103 - DNA, 692 bp, Picea glauca
  Predicted polypeptide sequence is orthologous to G1145
ttttttttttttttttttctatgaaaatcagcacctgaacaagaaaccgaccattacataccttccaaagatggaaaatatcaataatccatgattatacaccgctgtaaaatctcctgtaagacactgcaatcagcctatatataacaaaagagtttgggattaatgtacattgtagcaaccagagcctcccagtcaaattccagcattaatcgaagaacagaggctttctaaacataagtgaagattcagaagctatattttgtcacataattgccattctgatcttcgagccaatggtgcacatgactacaatctctgtacaaggctcaagatccatgttcacaagctgcttttgggtcataaaatcatcattcagtgcatcatgcatgccatatacacatgctgccacttttcagagacaaaaatatatacaatcatcaaatagatgccttgtagagaataccaaactgactacacaacttcaaaatggggcagtcatagtccttcgaagcggatgttttgtttgtccaggttgtattgaatgcagcaggtctgcagctgcctgctccttctcagcctggcgttttcttctataagcttattcacttcaatctccagctcatttgtgtaggcctgtctccttgctcttgaacgagctgcagattctcgattcttgatcatacgcttct

SEQ ID NO: 17104 - DNA, 833 bp, Picea glauca
  misc_feature (3)..(8): n is a, c, g, or t
  misc_feature (45)..(48): n is a, c, g, or t
  misc_feature (422)..(422): n is a, c, g, or t
  misc_feature (576)..(576): n is a, c, g, or t
  misc_feature (724)..(725): n is a, c, g, or t
  misc_feature (746)..(747): n is a, c, g, or t
  misc_feature (769)..(769): n is a, c, g, or t
  misc_feature (775)..(776): n is a, c, g, or t
  misc_feature (799)..(801): n is a, c, g, or t
  misc_feature (813)..(816): n is a, c, g, or t
  misc_feature (822)..(828): n is a, c, g, or t
  Predicted polypeptide sequence is orthologous to G1145
tannnnnnaactaaactaaaacccaagttatcataacaaaccgannnntaaccattcaaaaagctacaaagtacacacaataatgtgtgcttacaaacaattttatttggttttcataaaaacataaaaaaagaaaagccatgatcagtgatcaatttgtggccacaaaatttcctgaaacataacgctgaattaccccaatgtaggtcattctggaccacagcagacccgaaaacaaatttacagtggcacgcaaggccctcgtagctatatacttgcatggcttcaaaccaaaggctcctcttacttgacgaaaactgacaatgtatagctttctttggctctgctatcctaaactgtatgtctccacaactgtcttcaatatagaagcagctaagtccctcctaagtcataagtcgtanacctcatcttccaatacactaaactatctagcttatcagattggaatagagatacaaaattacagatagattagcgaaactgtgccacaaagacctcttcaaaattagaagtatgattgtctacaactccacttcaaaaaggagcagaactagnccttcgaagagtgtgctttggttgtggtggaggtacagtaggcagcaatttctccaggaactgttgttttttaagcctctcattctcctctttgagctgcatcacttcattctctagctcatttgtgtatgcctgctttcttgccctnnatcgtgcagctgactcacganncttaatcatccttttctgacgncgctcnncggttttctcaataatgctctcnnntgctccccgctnnnntactcnnnnnnnctctg

SEQ ID NO: 17105 - DNA, 689 bp, Picea glauca
  Predicted polypeptide sequence is orthologous to G1146
ttttttttttttttttttaaaagcaccaaggccagaagatcattatctgccttcttgtacgaattattcattcacatgatattctaacaagagataacacaacataaaaccaaacaataggttttcatgggcactcagatccgaaggacctcaatgcttctgatttggttattctgtcaaggatcagttctgtagaagccgtactttgaagtgtgatgaatgaagtttattttatacaaatgacagtctagaatacatgattcatagaatacattagcagtagaacataactctcttcacattttccttaatagctggcaaaggccgaacagcagcagctccagtcccaggacgagtgctacgggtacccgaactactagcagctacactcctaccaggaagtccactatgtaaagatccgctgtctgacgtttcaggctccatgtagaagcgagctcgaaatgcggccagatgcgcataatatgcgggaggaacgattgaaacagagcgtgtacaccgagcatatctgaataccagcatgactgcaaaggtagaaatcaaactcagttggatgacaaatcttggaatcaactacagtgcctggcaatatgttaccacttctatcaacactagtcctgtcacgatgattatgagcaaataaccttgtgtgatgacgtttttgaactact

SEQ ID NO: 17106 - DNA, 938 bp, Picea glauca
  misc_feature (802)..(808): n is a, c, g, or t
  misc_feature (813)..(813): n is a, c, g, or t
  misc_feature (815)..(815): n is a, c, g, or t
  misc_feature (817)..(822): n is a, c, g, or t
  misc_feature (869)..(870): n is a, c, g, or t
  misc_feature (872)..(872): n is a, c, g, or t
  misc_feature (878)..(880): n is a, c, g, or t
  misc_feature (899)..(900): n is a, c, g, or t
  misc_feature (918)..(924): n is a, c, g, or t
  misc_feature (928)..(934): n is a, c, g, or t
  Predicted polypeptide sequence is orthologous to G1146
cggtggaagaaacactgtcttagttgatgcactgtcaaggaggatacctttggttagtgacaaacctacaataatctttggagcagatgtaacccatccacaccctggagaggattcaagtccatcaatagccgctgttgtagcatctcaagattggcctgaagtcaccaaatatgcaggcttagtttgtgctcaggcacatcgtcaagaacttattcaggatctttataaagtctggcaggatcctgtgcgagggactgcaactggaggcatgataaaggaattgttgatttccttccgaaggaatacagggcacaagcccgagcgaataatattttacagagatggagtaagcgagggccagttttatcaagttctgttgtacgagttagatgctatacgcaaggcctgtgcatctcttgagccaaattatcagcctccggtgacttttgtggtggttcaaaagcgtcaccataccagactcttcgcaaacaaccatcaagatcgaaatgctacagataggagtggaaacattttgccaggcactgtagttgattccaaaatttgccatcccacagaatttgacttttacctctgcagccatgctggtattcagggaactagcagacctgcccattatcatgttctttgggatgaaaacaaattcacagctgatggattgcagtccttaactaacaatctctgttacacatatgcaaggtgtacacgctcagtttctatagttccaccagcgtattatgcccatctggctgcatttcgggctcggttttatatggagccnnnnnnntcagntngnnnnnncttatctagtggtgttcctggtagtcgcatgactgctgctagttcanntnctcggnnnactcgtgtacctgcgggannaactgttcggcctttgcnnnnnnngaannnnnnngtca

SEQ ID NO: 17107 - DNA, 717 bp, Picea glauca
  Predicted polypeptide sequence is orthologous to G1150
ttttttttttttttttttcaagccatttatttttatttatgtggacgattttgatacaaaatgtgtaagaaaccatcgtctatgcctgaaaatgtaaatcgacttaaaattacaacggcacttggaatcagaagctgcagaagggaaaatcacccaagcacaagcctgaaggtaatacttttctttatctcaaactattccggaattgccttctgtatatatatggactctgttgcatttccaggaccttcagagtattgagacaaaaatgaggaatggtagcacaaaaagcctacaaaaccttttcagatctcactaagattacaaaacttatgcatgctttcacccttgtttaagctattcaagtttgttcataagaaactcagtcttctttcaacagtaaaacattaatttcttgacattttcattgagcttcggaaggggtagaggttctattgaaggacaaagtctggaacgcccacttctattagaagaaacctcagaagcactagtcgatctgcttgaagacgtctcggaaatgctcccagacttatccaaatacagacgagctcgatatgctgcaagatgagcatagtatgcaggaggcaccaaagagactggctttgtgcacctgacaaaggtgtagcagagattgttgataagttgctgcagctcatcagatagaaaatgatttttcatcccacaacacatgataat

SEQ ID NO: 17108 - DNA, 931 bp, Picea glauca
  misc_feature (849)..(849): n is a, c, g, or t
  misc_feature (851)..(853): n is a, c, g, or t
  misc_feature (878)..(882): n is a, c, g, or t
  misc_feature (884)..(885): n is a, c, g, or t
  misc_feature (887)..(893): n is a, c, g, or t
  misc_feature (899)..(908): n is a, c, g, or t
  misc_feature (913)..(913): n is a, c, g, or t
  misc_feature (915)..(917): n is a, c, g, or t
  Predicted polypeptide sequence is orthologous to G1190
gttggggtggtgatttgctggatcgtggaattatttcagtgtcactggcgcccagagataaccatgaagcgcaagtgcagtttgcacttgaacgaggtattcctgcaatgctgggtatcatctctacacagcgacttccttatccatccaatgcatttgacatggctcactgctctcgatgtcttattccatggacagaatttggtggagtctaccttatggaaatagatcgagtactgcggccaggaggcttctgggtgctatctggaccgccagtaaactatgaaaatagatggcatggatggaacacaactatagaagagcagaaggataactttgatgcccttcaaggtcttttgaacaagatgtgctataagctatacaataaaaaggatgacattgctgtatggcagaaatctttggacagcggttgctacgctagccgtgaaaaaacagtttatccccctgaatgtgatgacagcattgaaccagatgctgcatggtatgttcccatgcggtcttgtatagtaaaaccaaatccaaacttcaagcacttaggagtaggacagactccaaagtggccacaacgcttgaaggtagccccagagcgggtccgtacattcgctgggggcagcgatggtgcattcagaaaggatacaactcaatgggtggagcgcgttaatcattacaagacattggtacctgatcttggaacagataaaataaggaatgttatggatatgaacactctttatggaggttttgctgcagcactgattgatgatcctctgtgggtcatgaatgtggtttcctcttatggtctaaattccttgaatgttgtttatgatngnnnactaattggtacatataatgactgnnnnnanncnnnnnnnacctannnnnnnnnntatgntnnnctgcatgttgatgg

SEQ ID NO: 17109 - DNA, 2880 bp, Picea glauca
  Predicted polypeptide sequence is orthologous to G1272
atggagtccaaggatatttcaggcccgggtgatggagcagggccttcttttagtcagtccgttgaagttctgccatcctctcccccaaatcctcctcaaatggaaacacagctcgggccttcttccagtgaggctgttgaagttctgccacccccaccccccctgcctcctcaaatggcacagaaactactagaggttcctcgtgttgttctaactaaacgacctggacacggtcgagctggtagacctgttaagttactctgtaatcacttcagagtaagcttttcaaatctccaggattcatttcactacgatgtcaaaatcactgcttctgaacgtgttgaacgtgggggtaaagcacaagatgttgttagtaagatattgtgcaggaaagttatggataaagtcaaagaagtatatggtgccactggactggatggcaaagattttgcttacgatggagagaacagtttgtttaccgttgggcctctcagaaacaacaacattgaatgcattattgttattgatgacgaaaggagctcaagaaggcctattaaagatgaaagccccagccagattgagcagtcaaaaaagagaagagaagatagaggggagaaattcaaggtagaaattacatttgctgcaaagatctcaatgaaagctctgcaggctgttattcaaggggaggtttctgataaagcccaagatgcattgagggttttagatatagttctgagacaacatgcctctaggaagggctatttgttggtgaggcaaagtttctttcattggagttttgctcctttggttgaactaggaggaggtgttaccggatgcaggggctatcatatcagcttcaggcctacacagagtgggctttctcttaatatggatgtgtcaacaacgatgctcatcaaagaaagtgctgtcattgattttttgttggcaaatcaaagtgtcgrcaatccatggaagattaattggtccaaggcaaagcaagtgctgaaaggagtacgcattacaacagtacacactaatatggagtttaagatctttggtttaagtgaaaaaccgtgcaaagaacaactcttttcaatgagagtaagaagccaaggcagccaagaagagcctcctcaaacagtggatgtgacggtgcatgattactttgtaaatacaaaacaaactcctttgcagttttcagcggatcttccatgcttggatgtagggagaaaaaaacgacccaattatcttccgatagagctttgcaaaatcctcccgggacagagatatactaaggctctttctactcaacaacgcacaycacttgtggagcaatccagacaaaagccagatgaacgaatgcaagtgttactgaaggcaatggatgtgaataattacaattctgacccattattgaaggcctgcaatatcaatgttgataaacagttggtacgtttagatggtcgagttcttgacccacccacgcttaagtttgggaagatggaagaggctccaaggaatggtcgttggaattttaacaacaagactatggttcgggcgtctaaaattggagactgggcaattgcatgtttcaattcaagaattcgttcaaatgaaataacgaacatggcacgtgagcttcagcaatgttgtggcagaagaggattggtaatggccgactgtttgggggttttggaagaaagtccgcaagacagaaatagaaaccctattgacagggttgaaaggatgctaagtcagatgaagtctagacttccaaagccgcctcaatttctgctctgcatcttaccagagaggaagaacagtgatctttatgggccttggaagaggaagttcctggcagacttgggggtcattaatcaatgtattgcccctccgaatatgaggaaagtcaatgatcaatatttaacaaatgtggctttgaaaataaatgcgaaggttggtggcctcaactctgttttatctgtggaatttgcgcataagatacctaagatatccacgaaaccaacaattattattgggatggatgtttcacacggttctccaggacatgcagattcaccttcaatttcagcggtcgtctcatcgagagaatggcccttgatttcaagatatagagcttcagtgagaactcaatcacccaaggttgagatgattgaagctttgtacaaaccgttgccctcaggaaaggatgcgggcatgatcagtgagctacttgtggacttctaccaatcatgcaatccgccacctaatgtagaaagaaaaccgcagcaaatgattgtcttcagagatggagtcagtgaatcacaatttgaccaggtcctgaatgttgagttacaagctatatataaggcatgcaatcacatagaggctggttataagcctaaagtcacactgattattgcacagaagaatcatcacacaaagctattccctagtggtggtccaggcaatgtgcagccagggactattgtagatgcccagatttgtcatcctagaaattttgatttttacttgtgtcctcaggccggcccaataggaacatcacggcctactcattatcatgtcttactggatgagaatgattttagtgtggatgatcttcagattcttgtccacgctctatcttatgtgtatcaaagaagtacgaccgcaatctcttcagttgcaccaataaactatgcgcatctagctgcgagccagatgcaacaattcctcaaggcagaggatctttcagaaacagcttcgcgatctggaaaaggggaagggtcagttgcatctggaggaggaggatacactgcccctgtacctgaactccctgtgctgcaccgaaatgtttgcaacaccatgtttttctgctga

SEQ ID NO: 17110 - DNA, 831 bp, Picea glauca
  misc_feature (729)..(732): n is a, c, g, or t
  misc_feature (787)..(787): n is a, c, g, or t
  misc_feature (790)..(794): n is a, c, g, or t
  misc_feature (797)..(805): n is a, c, g, or t
  misc_feature (812)..(821): n is a, c, g, or t
  misc_feature (823)..(823): n is a, c, g, or t
  Predicted polypeptide sequence is orthologous to G1272
agagaatggcccttgatatccaggtatagagcttcagtgagaactcaatcacctaaggttgagatgattgaggctctgcacaaaccatcggcatcaggaaaaaaagatgctggcatgatcaatgagctacttatagatttctacaaaacctgcaatcctccaccaaacgtagaaagaaaaccacaacaaatgatcattttcagagatggagtcagtgaatcgcaatttgaccaggtcttgaatgttgagttacaagctatatttaaggcatgtaatgatatagaggctgattataagcccaaagttaccttgattgttgcacagaagaatcatcatacaaagctgttcccaactggcccaggcaatgtgcagccagggactattgtagatgctcaaatttgtcatcctagaaactttgatttctacttgtgtcctcaagctgggccaataggaacttcacggcctactcattaccatgtattacttgatgagaataattttactgtggatgatcttcagattttggtccatgcattatcttatgtgtatcaaaggagtacaacggcaatctcttcagttgctccaatcaattatgcacatctagctgcgagccagatgcagcaattcctgaaggcagacgagttttcggatacagcttcccgatcaggaagaggtgaagggtcagttgcatctggaggaggacatgtccctgaactccctgctctgcannnnaacgtttgccacacgatgttcttctgctgagtcttactcagaattttttctgccntcnnnnnatnnnnnnnnnattcatnnnnnnnnnnanactccgct

SEQ ID NO: 17111 - DNA, 515 bp, Picea glauca
  Predicted polypeptide sequence is orthologous to G1275
ttttttttttttttttttgtgaaattaaaaaaaatatatactaagaaggagaaccgtacaacaagtacggatagtacaacatacaaactttctgaaattagcagcaaaattgtagatcgggttgtgaagttgatgtgcagaggtattaacaacaacagggccgagtgattggaggctgccaccgaacagctgaagcaaccatcaggacgtggaacagctgatgtaacggctatgtgtgattgggcttcaaagaagtggacgtagccaccagctagagaagccacgggctgcagccaccaaggtatatctaccgccacagcccgtcgagcaaataacgctcatgcaggggtcgagggcagtcgtacgcatggagaaagggaagtgacgacgcagggggtgcagccaacagttggtgggcagagtattgaagtagtggctcctgtcgcagccacaaggagaacccagccagccaccaggttgtaggatccacctgtacatcgtcagtagatctggcc

SEQ ID NO: 17112 - DNA, 704 bp, Picea glauca
  misc_feature (604)..(604): n is a, c, g, or t
  Predicted polypeptide sequence is orthologous to G1327
ttttttttttttttttttactacaacatacatgtactcttaaataagacatccacaaaaggatattacagattcatatagaaagcaaagacaatacagattaaacagaagcactgaaaatagccaaaggttcgttcttcttatctttgaggtaattaattcgaaggatactgtgatgttggggacattacagaccacatgtcgtactcatgattcggagcttgagcctgcgagagctgctgcatatgttgcgacacagaagctgaagctggtgttgcgtgcttgtaattcgcttcgtccagcaactgatcctcagtcataaaggactccagaaaataagagaatatatctgaattacaatcttcggtggtcgcgcccagtggatttatgttggcttgaagagtacaggaatttgcaccatcgttttccttgtagctttcttgatgggtttcttcagtgactgcacggtgttgcatgggattcgttgaaaaactttcgtattgatgtccacctctcaaagcatttctagctgttgtctgataaccttgatctgagaaatgttgggcgctgtctagccctgatgagggtgccatgaaaaagctacnttgtcagtgtgtttgttctcaaatacggagaccaatcatggccttctaagctcaattcctgagtagcgtaacagtatggaagttgcaagggttgattaat

SEQ ID NO: 17113 - DNA, 438 bp, Picea glauca
  misc_feature (4)..(10): n is a, c, g, or t
  Predicted polypeptide sequence is orthologous to G1335
gctnnnnnnnacttcaattgcacgcgctacctacacaaatatatagaaacttaaggcgggtaaggcggtaacggcccataagtcgcgccggagccaggcggctgaccgccatcgccatagccgttcttagtactaaccaggcggcgaaccatatccgctataatccttccagaatagtactcgccatcgccacctctaccagaacccgagcgccggtagccactcccggtagcacgggaagcctcgctgtgaccatatacatgaccagtacagagaaacagactcaaagcaagcacaaatatgcagagaaatttagtcatgctggtcgccattatctacgatattgagcctcgggaagagctagattaggcgctgatgagatggagagaagtaacctttcatatttatagacggaaatttcttccgtcgcctcgtgcc

SEQ ID NO: 17114 - DNA, 909 bp, Picea glauca
  misc_feature (2)..(2): n is a, c, g, or t
  misc_feature (4)..(4): n is a, c, g, or t
  misc_feature (9)..(20): n is a, c, g, or t
  misc_feature (26)..(28): n is a, c, g, or t
  misc_feature (35)..(42): n is a, c, g, or t
  misc_feature (45)..(50): n is a, c, g, or t
  misc_feature (55)..(55): n is a, c, g, or t
  misc_feature (84)..(84): n is a, c, g, or t
  misc_feature (86)..(86): n is a, c, g, or t
  misc_feature (88)..(88): n is a, c, g, or t
  Predicted polypeptide sequence is orthologous to G1340
tngntggannnnnnnnnnnnggtcannncagctannnnnnnntgnnnnnnaaagnacggatggataagagattgccgaccaatnanancaaggaactatatgatgcaatgaataaacattttggtcagaaaggaaatgatgttggagatatgattattgatacatccgcatcagatcatggaacatttgaagattgccttacacctgcaaaaaatgtgataatgcatgagaattcaatgcctgagactccactccagagccccggtgatacctctagtgatagagataagcaatatccagggaaaaagcgaaaagcagcatcaaagtcggcaggtattaaggcaaccttgtctgagaacaataagatgatcatttcaaaccttaagatggccgaggaggggcggatgaaacgccatgaaaaatattgtaatctgtttgaacggagaatggagatggatgagaaatatctgaaccaccatgcaatgaatgtgcaacggatgatcaatgttgaggagcagaaggtgaaagcacaacgtgacttggtatcggcattgaataccattggtcaggcaatgttgaagatttgtgagtcccttgatacaaaaggttgattgtctttgtaatctcttttgtagctactgcaatttgattaaaaagaatctgttgcccctaacaacagtaatagctatttatgcatgcatatctgccccctatttgaaccggatgaaatagaatttctgctgcagccttagcagcgtgatttaatatctctgcttgtgattcatgtgcttaagagctctgtagcgactcagagatgctattgttgcaaacaatattatttattcgaaaatacttattgtaatttttcaggaattcataccgttgtatctctaatagtgttcttttgaa

SEQ ID NO: 17115 - DNA, 837 bp, Picea glauca
  misc_feature (5)..(11): n is a, c, g, or t
  misc_feature (19)..(24): n is a, c, g, or t
  misc_feature (28)..(31): n is a, c, g, or t
  misc_feature (34)..(36): n is a, c, g, or t
  misc_feature (53)..(55): n is a, c, g, or t
  misc_feature (61)..(64): n is a, c, g, or t
  misc_feature (66)..(69): n is a, c, g, or t
  misc_feature (113)..(114): n is a, c, g, or t
  Predicted polypeptide sequence is orthologous to G1380
gccgnnnnnnntatgcagnnnnnnagannnnagnnnaagcgggatataggagnnngcgagnnnnannnntcgtcagctgtcaaggaaacgcatttcagaggcgttaggaaaannccgtgggggagattcgccgcggagattagagatcccttgaagaagaccagagtctggctcggcacttttgacaccgcggaagaagccgctcgagcctacgataatgctgcccgaaatctccgcggtgccaaggcgaagactaatttcggcccctccccactccacgacggtaacgccctgttcaacaacggcgtcgcccgcgccgcctctgctcagaaacaagactgtctgccgaggcctgttttttattccaagcaagagccgggcgttgccgttcttccgtccccttccgacaatcttcgggcttctacttgtgttagcgtcggggactcctttctaaatccggcagtggagaatcagacggtctccaacaaaaaacagaaacctttgttcggtacacatctctcggtaccatcttgcaatttacagcagcagcagaatgaagagatctgtcgctcaccggcacggccggcgcccttgtggctggaccttaatctgcccccggccgcaagcgatttcgacttacatatctgacgaacttataattttcacaaggcaggaaggagaggaacaacttttccgatctgagacgtaggcacaacttggtctatgccgtttatatccaatccgaggcagatttagtgtttgtttccgaccattcattttatttcatgtacagttttacaccatatttagatttaaaaggtttcagcgattttccaa

SEQ ID NO: 17116 - DNA, 887 bp, Picea glauca
  misc_feature (3)..(3): n is a, c, g, or t
  misc_feature (7)..(11): n is a, c, g, or t
  misc_feature (16)..(20): n is a, c, g, or t
  misc_feature (30)..(30): n is a, c, g, or t
  misc_feature (32)..(32): n is a, c, g, or t
  misc_feature (34)..(34): n is a, c, g, or t
  misc_feature (38)..(38): n is a, c, g, or t
  misc_feature (47)..(49): n is a, c, g, or t
  misc_feature (98)..(104): n is a, c, g, or t
  Predicted polypeptide sequence is orthologous to G1380
gcnagannnnncggannnnntaaatggctntngnaacnatgcgcagnnngagggtggggatcggaggttgcgagagcgaatcccgggccgtcaaagannnnnnnttcaggggcgtgaggaagcggccgtggggaagattcgcagcggagatcagagatccatggaagaaagctcgagtgtggctgggcacattcgacactgccgaggatgccgcccgcgcctacgatgatgccgccagggccttgcgcggcccaaaagcgaagacaaattttgctctcgccgccgacaacactgcctcggctgcgctcgctcggacgaccaacgcccgctggactcgaacgctgcaccctcagaagcagtggcctcatgatctgaaggcctcttccgtgccggctttggaatcaagcaagagacataaagtcttcttgggaagcgactgccggcccgagttcgagtctcgtaataattctccctgcgctgcgctttctgagcagaagacctcttcttccctgaggaaaaccccgttgctgctggatcttaacctacccccttccattgatgaggacaacgataacgagagcgcagctctgtagatataatggaaactattttgtaagggttgggctcttggtgttcctggcgtgcccaagcacacatttacaaactatatgtacagatttccattaatttttttttgtcaaatgatttgcacattgcttgacagaactttgttctgtagccactgcggcgtaattttgtttatggatatcacttggcctaaacgtattaggcaactatgccgggaactcttgtccacgcgtaataatcgttataaggaaagaaaatattttcactcgttataaggaaagaaaatattatcacatgta

SEQ ID NO: 17117 - DNA, 790 bp, Picea glauca
  misc_feature (28)..(33): n is a, c, g, or t
  misc_feature (36)..(45): n is a, c, g, or t
  misc_feature (687)..(690): n is a, c, g, or t
  misc_feature (737)..(737): n is a, c, g, or t
  misc_feature (740)..(740): n is a, c, g, or t
  misc_feature (742)..(742): n is a, c, g, or t
  misc_feature (763)..(763): n is a, c, g, or t
  misc_feature (781)..(787): n is a, c, g, or t
  Predicted polypeptide sequence is orthologous to G1380
aaactgtacatgaaatgaagagaaaacnnnnnngannnnnnnnnnaaacccttgttgtggttacatagggcatagaccaagctttgcccaggtctcaagttagttcaaagaaaagctgtttctaaccctagctttcagtcttgtgagatttacaaatttgtcagatgagttagtcgacatcgttagcggccgggggaagattaagatccagcaagaagggcggctgccgccgtgaagagctacagatcactgcatcctcctgctgctgtaaattacgagatgattcaaagagatgaatgccgaacagaagcttctgttttttggcggaggccgcccgattctccaccgccataacgcaactggaagctcgatctttgccggcaacggaaggaagagcgggagaaggagcataaatgttcgaaattacaccaggctcttgcttggaacagaaggccgatcgcggcggccattcttgtcgctgagcagggacggcgcgtgtgacgtcattactgaacagtgcagcggtatcgtcgtggaaagcgaaattagttttagccttggggccgcggagatttctggcagcattatcgtaggcgcgggcggcctcttcggctgtgtcaaaagtgccgagccagagtctagtcttcttccaggggtctctgatttccgcagcgaatctcccccatnnnnttttcctcacgcctctgaaatgcgttcccttcacaggggacgacgcngtntnctcgccccctcctatctccantttcacaccgattctcgnnnnnnncat

SEQ ID NO: 17118 - DNA, 730 bp, Picea glauca
  Predicted polypeptide sequence is orthologous to G1382
ttttttttttttttttttgatcgaataaactgatagaaatgaaatccccactaaccaatcgatgcaaaatattggctgccaaaaaatgagtcattgagaatggccatgacgtgataaactgcataacaggtgaagcttgaaccatgaacggcaaagtaacaaagtgaacagcaacattaagaacaagagttgttttacagatgaacataaaaatatatagtatgaagaaagcacaagtgccctttttacaggaaatttgtgtaaacgaatagagcctaaagatcagtttccatattgatcaatatcacgctgtgcataatatttgctaacaatataatggaccattcgactgcaaatctccttatacattagttgtcgctatttatttgtggatctccttatagctttcagggagcaaagataacggagctggcttctagactgaatggcagtatttacaaagcttggtgggctgcatacttgaggacaggttcaggacataagctcgcgttgacaagaactatggcaggcttagagccttgctacagtaatatgatgggttttccaatgtagtagattacagaggggctttcatggttgtgtgtgccctcatatgtagttatcagcagtctctgatcacttggatcacgttcgttttccgagcatctatagtagctccctgggatgagggctacttttaacgacctttctcccatacttgcgccatttc

SEQ ID NO: 17119 - DNA, 882 bp, Picea glauca
  misc_feature (3)..(3): n is a, c, g, or t
  misc_feature (7)..(12): n is a, c, g, or t
  misc_feature (23)..(23): n is a, c, g, or t
  misc_feature (25)..(27): n is a, c, g, or t
  misc_feature (35)..(35): n is a, c, g, or t
  misc_feature (37)..(37): n is a, c, g, or t
  misc_feature (39)..(43): n is a, c, g, or t
  misc_feature (54)..(60): n is a, c, g, or t
  misc_feature (100)..(100): n is a, c, g, or t
  misc_feature (849)..(855): n is a, c, g, or t
  Predicted polypeptide sequence is orthologous to G1451
ganacannnnnnagcgcaaggantnnnggcaatgntncnnnnntagccagttcnnnnnnngttacggacttactgaatgtgcctccttgtgctcctgtcnctgggttctctatgaattcaaatatgggtgtgtctggaggtatagatgaaagtgggttttcacagcctgcaccaaattttgcaaagatgaatacacctacaagaacattcactaaggtttacaagttaggttctgtcgggaggtcagtggatgtaacacgtttcaggggctatcaagagctgcgtgccgagcttgaccgtatgtttggtctagaaggccagctggaggacccaagatcaggctggcagcttgtatttgttgacaaggagaaggatgttcttctccttggggatgatccttgggaggagtttgtcaataatgttcggtttattaagatactctctcctccggaagtgctgcagatgagtcaggacgatatggaattgtggagttccattcccactcagcagcagacaagcagtagttcagaagattgtgtagctagaaatacttctcgcaatatcaattcagttctcacatcgactggatcactggattattgagtgtagttcaattgtactatatcaacagttgtgttttgtctttaaaggggatcctaaaaaatgagatgtacttcaattcagaactcttaggtatgccccataatatgttcttccaggatatctaaatgatgaagtgggatttagcatcattttctctgattgaagttgataacttgctgcattgttctagaaccgtctttggaaaatatttccttgtatctctatttatactctagttttctcttnnnnnnncaaggatgaagaatgctttgttcctga

SEQ ID NO: 17120 - DNA, 896 bp, Picea glauca
  misc_feature (784)..(784): n is a, c, g, or t
  misc_feature (786)..(786): n is a, c, g, or t
  misc_feature (821)..(821): n is a, c, g, or t
  misc_feature (829)..(831): n is a, c, g, or t
  misc_feature (853)..(853): n is a, c, g, or t
  misc_feature (855)..(863): n is a, c, g, or t
  misc_feature (868)..(877): n is a, c, g, or t
  misc_feature (881)..(881): n is a, c, g, or t
  misc_feature (883)..(887): n is a, c, g, or t
  misc_feature (889)..(889): n is a, c, g, or t
  Predicted polypeptide sequence is orthologous to G1451
gttggaggtgccttgtcccaactcccttcatcccaatctcagccagcaataacattgccatcgtccatgtgtccaaagccattgtttgcagattccaatggaaatctttcttcagccatgacgattccaagtatatctactcttcaaaatatattaggctcttcgtctggaggagaaaattccaactatttgaacttgcccagtactagctctgtagtccatcagcctgtgggaatgttaacaggacatggtattccccgtgattgccaaatttcctctagttcatgggttcaaaagctgttagcaaataatgtggtcccctgtcatccaggtggacaagttgaacatcttccttcaggaggtcaatgtgttgtgccccaaacagaatctcttggccagtctaatattccatcgtcatctatgccaatgtcattacctcaattcacatcaagagaatgccctccagagcaggaaattcagtctgattctcagagccaccttctttttggtgtgaacatagattcctcatctttgattgttcctaatacagtatcgaacatgaggaatgttggcagtggtagtgatgcagtcatgcaatttagtgtttctaattatttgagcgcacctccatgtgcttctggttctaatatttcattgaattcagacatcagtgcttctgcatgtttggatgaaagtggacttttaccacccactgaaaatttgggacagatgaatgcacctacaagaaccttcataaaggtttacaagcaagggtcagtcgggngntctctcgatatctcacgcttcagcagttatccagngctgcgtnnngaacttgcccgcatgtttggcntnnnnnnnnnccagnnnnnnnnnnctcnannnnnangctggca

SEQ ID NO: 17121 - DNA, 485 bp, Picea glauca
  Predicted polypeptide sequence is orthologous to G1480
ttttttttttttttttttaaattaaaatttcattaaattacagggaaaatagactttaggtaatcacatggtacaaattttacaaaccagaccaggccggtaattagtgcaaaaattacgtggcaataaactggggacaataatctttacaagtgaatcagatacctgccttccgccacatgcaaccctagagtcaacacgtcacagaccactagacaaatccctcgggcggtgttttcacatttaaaacgacgggacgaggccgtagctgagctcggccgacgtgtacatctgagccacgtcagcatcgacccgcttggcaaagcgccctttgatccgcggcctggtctctgcataagccttcctggaagcatacctgatcgtcttctcgaacttccggttctttcttttctccttatatctcaaaaccctagcttcgcggtccagctggacgtactggatgcccacgttcacaacgcctgggc

SEQ ID NO: 17122 - DNA, 795 bp, Picea glauca
  misc_feature (713)..(715): n is a, c, g, or t
  misc_feature (722)..(723): n is a, c, g, or t
  misc_feature (738)..(738): n is a, c, g, or t
  misc_feature (740)..(750): n is a, c, g, or t
  misc_feature (759)..(760): n is a, c, g, or t
  misc_feature (762)..(768): n is a, c, g, or t
  misc_feature (785)..(785): n is a, c, g, or t
  misc_feature (789)..(789): n is a, c, g, or t
  Predicted polypeptide sequence is orthologous to G1481
agaggcctaccagctctctgtctatacactgcacagagagataaagtcagaggcccatatgccccctgcaccacttatacatcgattttgtcgattgcagcagccgaaacgacctttcacacatcagattttattccacaaataaataaataaataaatatgctaaccaaaaaaactacttccctacagtccctgcaacaatggcagtgcaaatttattagggttatttgcttgataacaataaagatgaaattccttcttggccataatcccatcccaaccttaacctaaacctctgctaatggtacatatggtacacaagctcagtctgctgccgctggtgatgataatttaaataatattagaccgtggtttatgctttagaggttttgaactcgggagcttcggttgtagcgaggcggtgaaccatggccatgaaggaactggcagcggtggcggaagtgctcgttcggctctcgtgaacaaactcggcaaacggcagatgatcgaccaccgtcgtcggctgcctgtcgtgagaagtactgactatagtagaaataggaataatattatgatgctcttgctcgctgttattgtcgctgtcttcttcttctgcctccattttatcatcatcgtaatcgtctacaacggattgctgttggtgctgcggcgccgactgcatgtcgtccatgtccatcacgtccatcacaagnnnttcttcnncagagctcgctgatngnnnnnnnnnnnattctcctnncnnnnnnngaacgttgcctgcattnctcngctgct

SEQ ID NO: 17123 - DNA, 887 bp, Picea glauca
  misc_feature (776)..(779): n is a, c, g, or t
  misc_feature (789)..(794): n is a, c, g, or t
  misc_feature (848)..(860): n is a, c, g, or t
  misc_feature (865)..(865): n is a, c, g, or t
  misc_feature (867)..(869): n is a, c, g, or t
  misc_feature (876)..(881): n is a, c, g, or t
  misc_feature (883)..(883): n is a, c, g, or t
  misc_feature (886)..(886): n is a, c, g, or t
  Predicted polypeptide sequence is orthologous to G1482, G1888
tttgcaggagatacatattgttgtggggaaactggatcggtaatcttgaatttgttgcagattcggagaaagatgaaggttcaatgcgacgcgtgccagagcgcggatgcatctgtgttttgctgcgcggacgaagctgccctctgtatgaaatgcgattccaaagtccatgacgccaacaagctcgccagcaagcaccgcagactgtctctcctcgagcccagctcatcatcctcaacggattctctgagatgcgatatatgccaggaacgaagggcgttcttcttctgtcaagcggatcgggctgtcctgtgcagagattgcgatttatccatccattctgcgaacgaattgactgcaaaacataacagatttttggttcctggcaccagagtttctctgaaaccaatggagactttgtcctgccctgagaaagcggtggccactgtcaccaaggcattaatgccacctgcccaaaggatgccgaatcatgcccagccatcaatggatctgcctgtagaaaccgtaacaagtaccagtaacagcgacttctcacagtatttgaacgaggttgagcaattcctaacttcggcttcccctgagcgtctcgactggggtggttcatctgagggtgacgctattggaaagtacatggactcggactgggcacccaatctgggcctcctgcctgaaggtttctatggagactcgctggcagaagtccctcacatgccatcgcccataacagattctggattctgtatatatagccgatnnnncatcaccatnnnnnnaaaggcaaagcagcagcagctgcagcaggtgccatattttcttcctggtttcgnnnnnnnnnnnnntaacntnnntgttccnnnnnntntant

SEQ ID NO: 17124 - DNA, 639 bp, Picea glauca
  Predicted polypeptide sequence is orthologous to G1504
ttttttttttttttttttttggataaaaacagtcgactaaagatagctcaatattattaaagaagatataaccatagaattccaagcataaaataggaacaatgttgctcgaacgttacacagagttgcttgaagcctctgactttatcctttaccagatgcttccggttatcactgtgtagcaagtatgcccttcccgaagctgagagtattagaatcaaatgtagacagcatacaacatctcttccccaagctggaagtattagaataaaatgtagccaccatgcaatacgctcttccccaagatgggagtattagaaaaaaaattaggcagcatacagcatactcttccccaagctgggagtattagaataaaatatagccagcatagaacactctctcaaaagatccctgctgctgagatgctgtaggtgggggtatccagttcgccaaactagcccaaaatttaaaaccgaccccaacagcaagaaatggaccgcctgagagagcgagcctgcacgcaagggacaaaacgattggcagagcctccatctctgggaatttgaaccttggccaggtatgaaacacccctactttgccatctaaccaataactgttggcagatcctcccctcgtccg

SEQ ID NO: 17125 - DNA, 826 bp, Picea glauca
  misc_feature (674)..(678): n is a, c, g, or t
  misc_feature (680)..(680): n is a, c, g, or t
  misc_feature (690)..(691): n is a, c, g, or t
  misc_feature (694)..(695): n is a, c, g, or t
  misc_feature (737)..(738): n is a, c, g, or t
  misc_feature (751)..(752): n is a, c, g, or t
  misc_feature (761)..(765): n is a, c, g, or t
  misc_feature (777)..(777): n is a, c, g, or t
  misc_feature (779)..(780): n is a, c, g, or t
  misc_feature (790)..(792): n is a, c, g, or t
  misc_feature (804)..(807): n is a, c, g, or t
  misc_feature (812)..(812): n is a, c, g, or t
  misc_feature (821)..(821): n is a, c, g, or t
  Predicted polypeptide sequence is orthologous to G1510
tccacacacatgccatcctctaatcatttcccttttgttcgcatttacccggatgcaactgatctctgctaatttttttacaaacactgacctatccccaattcacaagctctcattctgcgagcctaaattaacataaccaacttctccaatgaagttggtacagaaacgatctcccaaaatgacataattatatcatctgcacagtgtatgttaaatagtagcacagttcaactatctgggtgcttatacatgttctcattcaaatattactcagtcattctgctttgagctccagctctgcaagctgtatattttatcagaacagtagaaaataagaggggtatccagagcaccagattgtgacagctgctggcttggtcttggcacggttttcatatgttttgcatcggtattctatcagtttggtagccataaatttcctgtttatagaataaggatggcagcacagaatattgcaggagccttcctaagaggtcaggtaggaggtacaccctgttcctcccagccaattatcattcctggtgcttcatctggcccttgttcaacttgcacacttccattcccgttgggttcctctccgtcttttcatcaccacggcatccattctcatttgcattcaccaggggaagttggaaattctctattaagcnnnnngngcaggctatnnagnngtgaaggtggaactgccccttctaggggctacagagatgtanntgttactgctgtnncatcttttnnnnncctccttggtgncnnattcaaaggnnntgacacagctgnnnngactngacagcagnatgct

SEQ ID NO: 17126 - DNA, 843 bp, Picea glauca
  misc_feature (7)..(7): n is a, c, g, or t
  misc_feature (779)..(780): n is a, c, g, or t
  misc_feature (799)..(801): n is a, c, g, or t
  misc_feature (811)..(811): n is a, c, g, or t
  misc_feature (813)..(814): n is a, c, g, or t
  misc_feature (819)..(821): n is a, c, g, or t
  misc_feature (829)..(832): n is a, c, g, or t
  misc_feature (836)..(836): n is a, c, g, or t
  Predicted polypeptide sequence is orthologous to G1510, G1779
tatatancttattttctttgtacaatattgggtgctctctaatccaaattctggaaaacggcaccacacagactcagtaaatagataataaatagataaatacagcgattaattaattaagcattaacaagtccacaagataaacccatcaacagcaccgctccctcttcttcgtccttggcaaacgatctgcgcatcttcatcacggaattggtgctcgtttcccctttctcatccccagcaacgcttccattattcaagaaccggcgctcggttgaactggaatcttccaccgaccggcgctcggttgaattggattcttccacgaaccgccgacgatccctgtgacgaccgcccgtagcggcggcgatgttctttttgcgcaccgggtacctcgcggcggcgatggctgcatcttgcggcaacagatcatattcatctctgtcttgttgcttgcgcttccctgtcatctgcctgacggacgacaggggagggagccttgaacccgttttctgctgctcgcgctttccgatcttcttgaaccgaataccgcaggcattacacagagactttggtccgtccgggccatttctccagagcggcgttctgtctgttttgcattccgcgcacgtcctggcaactgctccatctggaaatttagcgtccgttgctccagttttatccgagtgattttctccaatctgtaaaaacctcctcagcgactgtagactttctttggcgctacttttctttctattttcctgcaactttctttcgtnntcgtccccgacttcttgcnnnggatcaatantnncagannnacggagcnnnntccntcgtgcc

SEQ ID NO: 17127 - DNA, 786 bp, Picea glauca
  misc_feature (734)..(740): n is a, c, g, or t
  misc_feature (775)..(781): n is a, c, g, or t
  Predicted polypeptide sequence is orthologous to G1672, G2802
cctttttcttgtatgcatatatatttacgatctcgttgataaaacgtagctcccagtctatcagatcagaaattcgttgttatcttcaatattgttcttgacatccttctgaggttattgggatgaaacagatatgatcactgaattccccaaaacatatgatacccaataaaagtatcaatggctgacccaatggcaaatttttctgggaaggagaggagtaatgcaaccaacagctgcagtttgattgatgccaaacttgaagagcaacaaatcagtggatcaaaagtatgtcctagctgcggtcacaagtttgaattcaaggagggtattcaggattggccagggcttcctgcaggagtgaaatttgatccaactgatcaagagcttctggagcaccttgaagctaaggttgagattaatggccacaaacctcatcctttaatagacgagtttattcctacgctggaaggagaagatgggatttgttatacccaccctgaaaaacttccaggtgtgacacgagatggtcttaatagacatttctttcatcgcccttcgaaagcatacacaacaggtactcgaaagagaaggaagatacaatcagaatgtgatttacagggaggagaaacactttggcacaagactggcaaaaccaggccagtgtcagtcaatggaaaacaaaaaggatgcaagaagatcttggttctgtataccaactttgggaagcacannnnnnntgagaaaacaaattgggtgatgcatcagtaccacnnnnnnntgcaa

SEQ ID NO: 17128 - DNA, 808 bp, Picea glauca
  misc_feature (749)..(749): n is a, c, g, or t
  misc_feature (765)..(767): n is a, c, g, or t
  misc_feature (802)..(806): n is a, c, g, or t
  Predicted polypeptide sequence is orthologous to G1743
cccatttcatgagagactcggctcggctcccttctgaagaagagaccccagtgttgggctcagggctggcgcaattgcccccgatagctgaagaaatcaggggaagcctgcctgttactcaatatgaatcatcacccacaaatgcccatgtggtggaatgtgctgtttgtctgtcaagttttgaggaaggggatcacataaggcaacttccatgctgccatttttttcacagagtttgtgttgataaatggctggatcaccaacagacaacgtgccctctctgcagagcatctcttgtgccagaggagacagccaataaactgaggagaagggagcaagaactcacagaggagctcatgttttggttctcttctttccatggccatggattcaacagcatgtggtggttaaggtagctttttgttattgttatcccgttcaagtttttaaaattattctcagcgcagatagattatctaagatacccatcaagggtttcctcctctgtatttcatttatatataatttagttttgtccttacttttagaaagtaaggacaccctatctgtcaattgttgtggcatggcccatcagtcaaacagttaggcatttagcctggatcttgtatatgaagttctgtacatgtatatactttttttgttctctttttacagatatatttgtcttccaatcggggagggatgacctatttgattgaattctatagcagggttgcattttgatatangatctctccatatgtnnntttttgttatctctcgacatatatataattttctnnnnnct

SEQ ID NO: 17129 - DNA, 663 bp, Picea glauca
  Predicted polypeptide sequence is orthologous to G1765
ttttgtttttttttttttatataaattaaatttgatatttattgattataatttaactcttatgattcaaatgacccagtacaacacatacaaacatggccagtcaattaaatgaactgtaatatatatgtagggcggataaacagattccgcagcaaaccagcaatatcatcctcccaaaaagagtaatgatctctgtaattacttatctatatctgtgcaataagaacatctccgtgtttttgaaaggaaaaaaaaaattgcacagacaaaattgaagtgattaatggaggaactctggaccatttcatacaaatgcaaaacctcctccttacttcgtcctcatcgtatatcgaaactgcttttctccaacatctactatttcatcgctttcaccctggattgccactgataatattgttactgctggaagtggcggaggtggcggtggttcggttgcaaccagaagttctgctaacttttttctcttttccatgcaggagattgccccaccttctccagttatctgctccgctgccataatagccaagctgatctaatttaacttcgaatctagactgatccaatctcttcgttggatctgatttataagattaaacagtacaagatctaaagattttctcaagtcaaaatcccaaactg

SEQ ID NO: 17130 - DNA, 829 bp, Picea glauca
  misc_feature (41)..(49): n is a, c, g, or t
  misc_feature (763)..(768): n is a, c, g, or t
  misc_feature (770)..(775): n is a, c, g, or t
  misc_feature (800)..(801): n is a, c, g, or t
  misc_feature (803)..(803): n is a, c, g, or t
  misc_feature (822)..(823): n is a, c, g, or t
  misc_feature (827)..(828): n is a, c, g, or t
  Predicted polypeptide sequence is orthologous to G1767
atagtcgatcgcagcttacatgatttttttttggtttacannnnnnnnntccaggcagaagcccaaatggcgcactgctccttccatgttaagaaaagcccgtcggaattgctacagtgaccccatccctccttgtatctcttgagaagagccctaacatcatcaacaacatcatcgctgaatgcagcatgtatgaatcctgcctccttcagcctccaagcccactgtgcgcccttctcccttcgctcataaacttcagaatcatcgcaggccaatatgttcaccatgctccttgcactggttctttcaagcatcaatctctcgttgctcgttctagagaagctctcctctagtgaatcgaaaaacaaggaaaaaaaacgaaggcattcgctaaaacaggaaccaaaatcctcatgagttaggtcgacctcgtcctctactacagtaacaatcttggggttcatgctgtagaacgtggacaatatggaatcccttccattcttagagacgcgttgcaggctgtggatacagttgatggcgagggcctcgtctggtctgattttgagggcactgacgttgagcttgtggagatggtgctgatggatgacactgaattcgaagggaacccccatgagcctcgcgaatttctccattcgttgccctatttctttcatgaccttgatggccgtggcttccttgctagtgaccacggtagtcaggcggagatgaggggtgtcgtcgcttctggtggccaaggcttctnnnnnngnnnnnnactgtgtacagaaagtgttgctcanntntactatgtggagcttcatnnctcnnt

SEQ ID NO: 17131 - DNA, 556 bp, Picea glauca
  Predicted polypeptide sequence is orthologous to G1772
ttttttttttttttttttctacatgatcttacagcggaacgattaattttgtgattgtacggacagatcacttggctgttagagattgtacaggaagcagtactggtacagctgatatgtgtacgaaatttttttttttttaattctcttcagaatttgcaacaaaataatttcagagaaactctgaaattatctttcctcaattggccttggcagcggaatagctattccttcaacagatagttgaatttttaatggtcaaagaccatgagatcagagaaactctgatcatttttcagttggctagaagcctgtggtgaagcagattaatttcttccttcaatttctttgacagcagaatgattattttttaaacagtgatttctgatttttttatttattttgcagctgattagtttcttccttcaattttctttggcagtggaatgtcttcttcaaatggccaaaggccaggttttggtcaaagaccgaagtttcaagaactttgaaaatttgaatggtcaaaggcctggttggtggtcaaagaccaaatttc

SEQ ID NO: 17132 - DNA, 490 bp, Picea glauca
  Predicted polypeptide sequence is orthologous to G1852
ttttttttttttttttttgttgtggcctaaataatgtaaataatgttcaataacctgaaatttaggtttggataatttgttatcagcaagatgcacactttgtaaaagtttctggtcaaaccaatagtgatcgatgacattgttgctaaaagaggcatgaacactagtttaaaatattacataaaataccacataccgaagagaaccaaattacaaaaacagggatccaactccaaggcttggcaccaagaccatccttcctaagtgatctgagtcacattacagacatgttcctaaaaaatagagcatttcaatccatctgcattgaggcagaatgctgaagtcctctttgaaaattgtaaaagcaaaaaaatgttgagagggctagtcaccctgaagtagaggaaagggtccaaaactgcttggtggccactaacaatttctctttgccatttgactctggctcagtgtcataaacttctgtactccc

SEQ ID NO: 17133 - DNA, 836 bp, Picea glauca
  misc_feature (755)..(755): n is a, c, g, or t
  misc_feature (757)..(757): n is a, c, g, or t
  misc_feature (759)..(759): n is a, c, g, or t
  misc_feature (768)..(774): n is a, c, g, or t
  misc_feature (809)..(812): n is a, c, g, or t
  misc_feature (819)..(820): n is a, c, g, or t
  misc_feature (823)..(835): n is a, c, g, or t
  Predicted polypeptide sequence is orthologous to G1855
gtcctataagtctcttgtagtttgcgaccctgtcagtccatagtttagaatcttcattgaaattttcagctgtaattcccggaatactgccactccttattcggggaggaacagctgttacacgcttcggccacttttctaaggctcctcctgcaactgcattgatatcattgacctctggaagtggtgttatgcaggtttccatctttctataccaagcagcatcagggttatcatttttacaaatatgaggaaccttgtaaatatttctgctcttcacacaatcaatgtgattcatgggcttttgccatatagcaagatcacccttttcaacaaccttcttccaacataaacgtttggcaacatcctcaatagcatcttgctcttgtttcagatcttcgggagttctttcccatcctctatgatattttttccaatttactggggggccagataaaatccagtaaccaccaggcctcaataccctgtccacttcaatcaagtagacaccatcataatctttccatggaatcagacatcgagaacaatgagccatgtcaaaagctcttgctggatatggaatcctttgagacgccatgatccctatcattgctggaacgccccgttccagagcaaactgcacctgtgcttcatgtgtgtcccttggtgcaaaggacatggttaagatattcctctttagcagatatgctccccaactagcaaccccacaccctgtatcaatggcagtcctgatngntncatctgtcnnnnnnntcaacttatcgatatcatcaatataagcatctgcnnnncgagtgnncannnnnnnnnnnnnt

SEQ ID NO: 17134 - DNA, 825 bp, Picea glauca
  misc_feature (711)..(714): n is a, c, g, or t
  misc_feature (754)..(754): n is a, c, g, or t
  misc_feature (758)..(759): n is a, c, g, or t
  misc_feature (769)..(769): n is a, c, g, or t
  misc_feature (805)..(820): n is a, c, g, or t
  Predicted polypeptide sequence is orthologous to G1855
cacatgaggcacaggtgcagtttgctttagagcgtggtgttccagctatgattgggatcatggcatctcgccggcttccatacccagcaagagcttttgatatggctcattgttcaaggtgtctgattccatggaataagtacgatggtatcttcttgatggaagttgaccggatcttgaggcctggtggttactggattttatctggacctcctataaattggaaaacacattttaagggctggcagagaacaattgaggacttgaagcaagaacaagatgaaattgaggatattgccaagcgtctgtgttggaaaaaaattgttgaaaaggatgaccttgcaatatggaaaaagcccacaaatcatcttcactgtattaaaacccgcagagtcttcaaggttcctccaatgtgtgaagatggtaaccctgattctgcttggtacaagaattcgaagacttgcataacccctcttccacaggtcaaggttattccagatattgcaggaggggctgtggaaaagtggccacaaaggctaacatctgttcctcccagaataaggagtggaagtattccggggattacagctgaaacttttactcaagacacccaactttggaaagctagtgtgtcatactatggaagtatgataagtgaacttaataaaggaagataccgcaacatcatggacatgaatgcttttctgggtnnnntcgctgctgcctttgtgaatgaccctgtttgggttatgantgtnntgccatcagntgctaaacgcaacacactcggtgtcatatatgagcnnnnnnnnnnnnnnnnatatc

SEQ ID NO: 17135 - DNA, 796 bp, Picea glauca
  Predicted polypeptide sequence is orthologous to G1880
ttttttttttttttttttaagatcaaaatccaacattattcattaatcacgtaatctttcatattgcaatggaggatacttctgctgctgaagtattctaatacacagatataattgacaagaaactgcgataaaaatgctcgattctattattaggttctgctctgaaatttctggctggctggttgcgaagttccgcaactaaccattgaaaaccataatcgaaaatcccaattttttcccatgttatgaaaatcatgtctgaacgacgtagacggacgggaacagtcgccattattagagacgatataatgaggacccccgctatcgtgaattctcttattgaaacatgacatgcaggtattcaaaatatccattcaagaaattcagagttatgttatgcaaggatcagctcaaagcttaccaaatttgacatggctcacccgttttgaagcagctggcaaatatcacgctgagagttccatcgttcgttcagggttcttttttgagaccattttgaaagagcacaggtctcgagaagttagatgcggagggatactcaactgggagcatcatagggattttattagagttctgatcaggctgccatgagggagggatatgacagagaaactgctggcgaaagcttggcaagtgatctctaggcgagtttcatcgattcgcctggttgcctgctcttttaataattgagctttagccagctgggcctgagcctgttctcgtatgcgcctcgctgcagcgaactctgcttcagctaattcaatctgcttcttgg

SEQ ID NO: 17136 - DNA, 885 bp, Picea glauca
  Predicted polypeptide sequence is orthologous to G1893
ttttttttttttttttttatcgatcaattagctttgctggaattagatcttgggtatataaatcaatgagataagaaagagacttagtcctcagagcctaaatcctcttcgtcttcgaaaggatctggggtgatgggcgtatatccttagccgaatgcccttttatgatctttgatggaactcttgtgcttgaaatctgagctacagctgtaaaaccagagcttcccacagttctcatgggtgcgccagtcgcccctgacagcaaaggttttgttgcacttgcaacatgaaaggtttaattccattcttgcgtttgtaatgtgtttgcaaagcggaagtccttctactgtttggcccggggaatgatctgttcttcctacacccttgtgtacagcgctagcatggaagtctcagcaatattggtgtatgctgagtgcctcgagcaatcattctaaccctttcttgtattgcgatccatgccccacatatgcatcttctgaaaatcttgttctgcttccgatcatctggccggctgcactatactctccttgcctgcgtctctggaatcagtaatcttcgagctcagttcggacttttcagataagttgttaggaggtcctatatgcacagataccattgcgttttctagtggatctgacctaaacttctcctccgcactctgttgttcttttggggcctgagacttagcagcgatggcagttcttctctcaggggcgatgactctcagtaccctttaggcggttgctgtagttgttgcatacaaagacgattctgatcattagcatggacatcattagcggcatgagaaggcacttgatgaccgaatgatttcactattaatgatcagaacgattgagaagactc

SEQ ID NO: 17137 - DNA, 706 bp, Picea glauca
  Predicted polypeptide sequence is orthologous to G1936
ttttttttttttttttttctttgggttcaacctaaaagcctttgatttcattggttgtttttttggttgagttgtccctacccttggatctttgacaagtgttgaagatccaagaggggtctccttggtttctttgcctatttaagaaacctctccctcactcttttctcaccaatctcttgctaactctattatgctgaaatttttcactccactctcttgctcttgccacattgccatccacttcacttgctctattatttgataataagaagaaagctttggaggactacatggtgcatttttagttatcttctatgctccaccacatgaggtgatattgctctactttttgcagatttgtttatggtattgatcttaggtttttacttaggtaagctagtcgaatgttatccatcactagtttatgattcataaagaatgacctaggtttgtagtgatctcttcttagtgttgttctagtaatctatctatgccatatacttgtatgtactaagcttttgcaggtaattttctaaagcttcacttgggacaaggttcgagaaagagtcctcccttgaggctttcacaaactccaatcttctttctttctatcataacctttttctgcagtcattccatataccttttcagcctttgttttagctttagataggtcatatatatcatttctatactctatttg

SEQ ID NO: 17138 - DNA, 711 bp, Picea glauca
  Predicted polypeptide sequence is orthologous to G1950
ttttttttttttttttttaagaatcaaaagacagatcttaagaattccagcgaggccttttaaataatgccgaatttctatgcatggaaaaagtaattcactcggaaattatgccgaaactagaggaatatataatcgattgtgtacaaaagaatttacctgagcaagattacatagggtcttaaatgtattgaaagacgtaacaaagtattataacatcaaagtctttagctgctctctataagcacctcttctcaactgttagctcaaaatgccacattattgttgtaacatcccatctttgaggcctgatggcatgttttagctaaaaagcataaatactatcagtcatcaagcatgactttggcagcatcaattagtgttctcctaaaatcccctgaagctcgaccaaggactgtataaccttcattgtcttcacaatcgacatctgcaccatgccttactagaagtaaagcaatctgcttgtcattgctgattactgcattcataagaggtgtttgacctgttttgtcagtggcatcaacatctgcaccttcctctatcaacagttcacatatttctgggtgccctgcacttgctgcgcgatgcaatggagtgcaaccaaacttgtcctttttcctgacgttggcaccattggagattaaatcttgggcaatcttaacccgccctttactggcagcataatgcaag

SEQ ID NO: 17139 - DNA, 683 bp, Picea glauca
  misc_feature (560)..(561): n is a, c, g, or t
  misc_feature (622)..(627): n is a, c, g, or t
  misc_feature (647)..(653): n is a, c, g, or t
  misc_feature (659)..(659): n is a, c, g, or t
  misc_feature (670)..(670): n is a, c, g, or t
  misc_feature (672)..(672): n is a, c, g, or t
  misc_feature (677)..(682): n is a, c, g, or t
  Predicted polypeptide sequence is orthologous to G1954
ctatgatgagagatgaagcaccagaggccgttgttgattttagtagttaaggcaacattttttaaacaacattatgtgaagaataattaagcccattagcattggctctagatgcaattttagctttgaattggtatgctactcgggcagtcgaccaatttccttgctttcgatacaattgttgttgagtgctgtaaaatgagaggcagccttatgagtgacaatgagagccttaaatgttcgacagactgatttgagatatctattaaaaaccagaggcagtattaaaacaaaagcactaaccatattactgagagcaaacaaacttcctcacagtatatggttgatacaaaagcacagatggaggtatgtacacctgcgagcaagaagacgggcattttcaatgaaaggcccgatcactagcatgcatgcactattctcaaaatttggtgaagtgatcttgctatatcattagctgatgtaagtgggcattcatcctcgaccttgacgttgaaagagaagagcacagcctcgtccattgaggtaatattgagatgcannattgtcatatgaaagccttcaagagcagtgatgatcttcaagagctgcccgtgcttcttcnnnnnnagaattttgaggctgccatnnnnnnngatcantgtgacctctntntctgnnnnnna

SEQ ID NO: 17140 - DNA, 638 bp, Picea glauca
  Predicted polypeptide sequence is orthologous to G1957
ttttttttttttttttttgtttagaaaataaagatttttaatctccaaatgagaggcgttttagttacaactaaaagggtagagcaacaccctaccacgaaaacaatcgccttttactgagccaaatttttggctgtatttactcctgaactccctatcaaggatacatcgggaaagatcatcttcttccatgaaggtcttcaactacctgaacctatgtaaatactgtacatatggtagcatgaaggtcttcaactatctgaacctatgtaaatgctgtacatagggcagcccttaatggctagacaattcagcaccacaaaactctaatggaggtgaggaaagttaatgggatcatgcgattcctttgaggatcgaaatttttatgtttttcaatggaagtacagttatatttcatcttcttataaatatgtacactgtatcagaataataatattacataagttgatatataatatatatttcaacatatataacattaattatttcaatgcagaatacataatctttacacagataaattgaaccttttataaatatcggtttaatttacaacagcttagaatgacagaatgacgtcatgatgaatatccacagccattaaaccttaataacct

SEQ ID NO: 17141 - DNA, 660 bp, Picea glauca
  Predicted polypeptide sequence is orthologous to G2010, G2347
tttttttttttttttttggaagatatgctcagagtaggtgcataataaaaataccgaccatttaagtacaaagcgaatgacaacattttaagcgtagcatacaagctcaaaaatgtcatgagactttcgaattctggacttcatatgttgtgcgagttaagctcaacacaatccaaatttcagatatttagatttacagttcatgatcgacagtaagaatccaatatgatgaattgtaaatataactctggccatgtttgttctgcacaaagagagctgaactgaggatgacagaagagagagagcacgcccagagtctaatgattttttatctccttgcaaactttagctgtggtgttccgctctagcaccattgtcatcttgtcagattccttcatatgtcttaaccagttgtcgttaagatgatgatttgaatctagtctgtcaactgatgaatcagagggagtctttctacggcgttcattgtggcctgccagccgtctcctacaactcctttttgcttcatcaaactcttctaacacatggaatctgctacattgctggcagaagcgctgctggaggccaagaacgagcacaactcgagccttggaatgctgctcgcaaaccctgtgcctcctgtagtactccttggcatccgca

SEQ ID NO: 17142 - DNA, 467 bp, Picea glauca
  Predicted polypeptide sequence is orthologous to G2011
ttttttttttttttttttagtcctccaaagcttttcttctattactgaaaaatgagagattagtggatgagtggcttgtggcatgagcaagagaggtggggtgaaatttcagcagcataacagtagccaaaagatagatgatccaaatgaggaggggtggggtctttcttatacccaaagaggcaaagtgaggggcccttgatggctgccatgtgttggcaatccaagggagaggaggcttctagagagagggcgccctaattagggttagggttttggataggtgaggtggcaagggcgtggggacacaagagagaagagagaatggccaagggggcgcaccttctagagagaggagggcccacgtccaagtggaagcccattgattggctaagggaagagagagggcgcaccttctagagagagggcgccacttgggtgagagaagaagggcgtggggaccacta

SEQ ID NO: 17143 - DNA, 718 bp, Picea glauca
  misc_feature (14)..(16): n is a, c, g, or t
  misc_feature (647)..(647): n is a, c, g, or t
  misc_feature (653)..(657): n is a, c, g, or t
  misc_feature (659)..(659): n is a, c, g, or t
  misc_feature (702)..(705): n is a, c, g, or t
  misc_feature (715)..(716): n is a, c, g, or t
  Predicted polypeptide sequence is orthologous to G2140, G2765
ttgatagttgattnnntacaacaccatatttccaatcgttgagcaataattctcttatccaaagtcatgcaaattctgatgatcatttggagaatacttggaaggatgttcacctatcctagatacaatccgaagaaatgtgaaccttatttcccccagccaagcatagactcttctttaccacaattaccacttaatatacccccaaagtagaaacgaggacaagaatgatctcatccaaccagataatatttactaacttataccaaggaacacactagaatatgtgtttgacacagcaacatttaaaacaattttgagaagcctgcagaagtgttgaaaaccacagataagtagccatagcttcacacgagaacaccatccaatatcaatctattgtgcaacataactgcacaaaacattacgcaactaattggcaaacaatgtaaaacacttcaagcatcaaatggcagaatcctttgccttttgtttgagattgaacttcccgccgataattcaccagatgcagcagtcctctccatcactgccctcaaagcttcctgtatagagttgattgatagtcttgtctggctttctacaaagtctttttcaccatcagttacaagaaacacatttttaacccttcnagccannnnngnaatctcagcttttacagttatcaacccaagggtctggaaagtnnnnattaaatcannca

SEQ ID NO: 17144 - DNA, 861 bp, Picea glauca
  Predicted polypeptide sequence is orthologous to G2142
ttttttttttttttttttgatgaaactttattccgtggactaacatatcaataattaataaaataatatttacagcagtttaaaaggtctatagcagaccaaaaccaaccaatgccataaaaaatctgtacatgtcatctaaaaatacatgctaagctttccagcttgcagataaaattcttcctggcacgtgagaggtacatgtaatctttattatggcgactgttgattcctctcagtaattgaattggagaggtgactgttaaaacaacctaaaacctagtaatttccctctttaatattgtctgttgttcccagcaatggaaactaagcaaccacaagcctggaatttgcttctagtctacactgcaaccacatacaactttttcataaagggaagaacttaaggctttcctctctcatgttttagagatcaaataaaatttttataaaaataacaacttgaggctttcctccttcatgttctagagattaaataaaaccaaaccctttatcttatcataacagattaattcatataattatgttgggacacatacttgggctggatggaggcctcatacatcttcgatatgcataatccaaagaatagacttaactaaacatctctctcaatctttggccttttctgtggctgctcacgctctgaggatgtatctgcagcccttgactgcccttgtaattgatgattctgggacgactcctcatgattgtgactatgctccttggtattagttgtagccccagatgttccaccccggcggccaaggtcaatctgcactgatatatttgcttgtgaaagatcgagccctgagttctgcaatgcttgcgttaatgtat

SEQ ID NO: 17145 - DNA, 797 bp, Picea glauca
  misc_feature (9)..(9): n is a, c, g, or t
  misc_feature (671)..(672): n is a, c, g, or t
  misc_feature (718)..(726): n is a, c, g, or t
  misc_feature (728)..(728): n is a, c, g, or t
  misc_feature (739)..(740): n is a, c, g, or t
  misc_feature (743)..(743): n is a, c, g, or t
  misc_feature (771)..(771): n is a, c, g, or t
  misc_feature (773)..(777): n is a, c, g, or t
  misc_feature (779)..(779): n is a, c, g, or t
  misc_feature (787)..(791): n is a, c, g, or t
  misc_feature (794)..(796): n is a, c, g, or t
  Predicted polypeptide sequence is orthologous to G2192
ttgtctgcnaacttcataatttgaaaggccaactgaaaagattgactcaaatttatgaaaacattcgccgagaggattggaggatcttctgagtcacagttctccagaactttcacatgagcttcctacatttgaagacatatcataaactacaagtttaattgcttttccgccggataaatttaagatgccaatgcactcttgcaaatccgcatcacatgctagtaaaacccactcatgatcatcatctaaatacttcagatcaaatgtgcctgcctctaatttgaacctttttgtgacttcatcatgcagttctgaaactcctgcattcaaaggcaatcgaaaacgaacagtgtcttgtttatacgttactttgaatattgttgatttgttcccctcttggataatcctgtctctttgcaaacctgctagatttaagattctagagtcgcatctatgttgtggagacaggtttcgggagtttgactgaatagcttcagctaaacattcaccctgaccactgaagtctgtaggcttttggtcgctagaggattcaacaggtaattttttgcgcttgcaattgacagctgtttcgctgtgtgtattttttagaatacttgaagtagcctgtcttttgtgcaagctagtttctccattgttaatgaattccnnttgggacattaagttttctccacctccatggcattgagatgctggnnnnnnnnnanatgcagtgatnntangtgggtccgcgtgatcttcaattgaatngnnnnngntctgactnnnnncgnnnt

SEQ ID NO: 17146 - DNA, 796 bp, Picea glauca
  misc_feature (30)..(35): n is a, c, g, or t
  misc_feature (48)..(53): n is a, c, g, or t
  misc_feature (55)..(61): n is a, c, g, or t
  misc_feature (765)..(765): n is a, c, g, or t
  misc_feature (767)..(771): n is a, c, g, or t
  misc_feature (786)..(790): n is a, c, g, or t
  Predicted polypeptide sequence is orthologous to G2192
tctattaattaaccccaaaggttccaaccnnnnnngcagagatatacnnnnnncnnnnnnnggaaaaatatccaacacctcccgaataaaatctagctaaacatcctgtccatagtataaataatcaaaaagcttaagcaactgctttaattattctatccagcaggaagccaaaactaaaacgtacagttgttcctgcattattaatgttgatacatgtttggacagtgagtcagtggacattgactatcttttcaaatacaagaggtgcttcccacaagcataggactaaccatgaaagaagtttacaatttgaaagaaaattgaaccattaggctcaaatctttgaagatttgacaccagaatgtcatgagctcatgattcacaatcccccagagctcccacaggagcttccaatgtttggacatacatcctgaactgaaagcttaattgtacgtccgcctgacgatttcaagatgtcaatgcactcaaacaaatctgcatcacacgttagtaaaacccactcaaaatcatcatctaaatatctcagattaattgtacccgagtccaactggaatcgtttggccacctcctcacaaagttcttgaaagcccatgtgtggagacaatttgaaacgaatagtatcatccttatatgttgctttcaatgtcattaacatgctctcatcttgaatgatcctaccagtttgcaatctacctgctggatttatattttctgatccttgatcacttctgttctttgcantnnnnntaaaaccttgatttnnnnngcttga

SEQ ID NO: 17147 - DNA, 835 bp, Picea glauca
  misc_feature (45)..(53): n is a, c, g, or t
  misc_feature (761)..(762): n is a, c, g, or t
  misc_feature (772)..(773): n is a, c, g, or t
  misc_feature (812)..(828): n is a, c, g, or t
  misc_feature (832)..(834): n is a, c, g, or t
  Predicted polypeptide sequence is orthologous to G2226
gatcatctccagaccttctcaggccaccttagaaaacctaaagtnnnnnnnnngaacaacttctaagttctaagtcttctctacatataggctttcctgctatatacagaagaagtattcactacataaccttcagaaaacaggattgctttcaataggagaagcaacaaagcatcctgtagaaataagcacttttcctaaagatgatttacaataaaagattacagaatctccaattatagacccagataactggatgaagtgttgaaggatccttcaaagcaggatccaagcaactctaactttcaatccatgtatgatgataagcagcttcttggaaggatgaacaccaaaataccgattcatctgtaagctcctgttccctgagcctgatattcttggctgcttcttcggatatcagacatgatctacacaagggacaggtgatctgctgatggtccagccatttatcaaggcaaggtctgtgaaaaaggtggcagcaagtcagctgtctgatctcaaccccttcctcaaatttggataaacagactgcacactcaacatggctattgtcactaccaacaaacccatcagtaaaagattggaaccttttgatgggtaggctctgcctgatttcctctgcaatgaactgcgcttcggaatggccagtactgactgcaggggtattttcaggtgggtaaggccatgatgggtcgataaaatcaggttcagtgcctgtggtaaggcctacaatctgaagnnaagacctcannatgtccttgataatggcaaaagacagagcagtattcacnnnnnnnnnnnnnnnnnctcnnnc

SEQ ID NO: 17148 - DNA, 668 bp, Picea glauca
  Predicted polypeptide sequence is orthologous to G2251
cagagaacaaaatgcacgggttccctattggttactgggataatgtagaagtcccccagctagtgctcaaccttgtgtttgtcttggaattgagcaggcttttggccaattggcttctctcccctttcggtataccagaccatcaatatggcgctccccgggatcagcccctcaccacttggcccatcactcctttaactaatactatcagtgttcgttattccggccttatcttctccgcttctatttcgccttcttcccctgtccctccataccgtgaccagcagagcgttcgtgagaatttgcccaccgtcttcgactacgggagtctcagagctgatcgccatgaggttgttgtctgtactgtttgtttcagtgactttgtgtcgcgggatcgagtgcgccggcttgctaaatgtggccatgttttccatatggagtgtttggataagtgggtcgaatatgagaactacatttgccctctctgtagatctcccatcttttagacacaggttgaaatcatcatcatcaactattataagtctgattgattgctgtgaattgttaatgtaagtctagtaggatagattttatggacattttgctggccacatgaaaaggcttctgtaataaaaatgtattgtggatttattgaccttttaatcttt

SEQ ID NO: 17149 - DNA, 834 bp, Picea glauca
  Predicted polypeptide sequence is orthologous to G2298
ttttttttttttttttttcaatgtctgaatggaactcaaaatggattaaatttgattatatacaaacaataatgaacatgtggtcctcattttcagctggcagctcaggttctcatatgtggaaaggagaggaacattcattcatcaatttctcaaataagaattagccttcttatcgggtttcttacccgctaccaaaaagaatttaaaaatcttcccgccctcgcccccgccttcgccttctgtgagctacaattgtaccccaaagtactccatggattcatccaacggggggaagtcatttaaatttggagacttgccactctccaggcattccagcagtatggaatcccaaaatgccggacagttctcctcccaaatctgttggccgtcattgccccattccgcttccgaaccagagaatgaaaactctgcgtcatcttcggaaggcagctggaactcttccgcggcgaacttggcggcagcggcttgaatttgctgcggcgatagagaagaggcgcaggggatttccggcgtgaaaaggggaaaattgagcttggctttcgatcctctcaggcaaaacgcagcaaaatcgtaggcgcgggcagccttttccggggtgtcgtaggagccgagccaaattctgcccgtgcaattgggcattcgaatttccgacacccatttcccccactttctcattcggattcccttgaactgccgcgacttaagtgagcgagtttcgggtctgctgtgactgttctgatttggcgaggatttagtcatgtgggggtatttgggcagcgaactgaggacgtgctcgtgaagcgtgatggc

SEQ ID NO: 17150 - DNA, 607 bp, Picea glauca
  Predicted polypeptide sequence is orthologous to G2298
ttttttttttttttttttggtttttttttttttaaaaaaaattattaaatgatttttgaaaacctgagataaaaactttgtaaaactcatacaaagtaataggaagtagttgatttacaatagggacttctaagaatagagttgagtttaactcaactttcaactatcagtcaacggtacttgacttcgattagggactagtaagaatagaatagagtttaactcaactttttactttcaggacagaatctcaggagcggaaagaaaatttagaaaccctcgtggctccagtcttccgtccgctggaagagaaccccaaaatccattgacacatccaagggaggaaaatactctatagagtcgccactgtcgagatcttcaagaactgaatcccaaaatgccggaccttgctccagctaaatctcttggccttcaatgccggattacgcttccaaacaagtagacagtggaagaagacggggcgtccttttccaaaggcagacagaaatcttctgcggcgaacttcgcagcgccggcttgaatttgcggcggagatagagaagaagcgcagggaaattccggcagggagtagggaaaattgaacttg

SEQ ID NO: 17151 - DNA, 621 bp, Picea glauca
  Predicted polypeptide sequence is orthologous to G2298
ttttttttttttttttttgcagttgtaaaaaatttctttatttccttccgtctatgggtaattgaatttaaattgagttattaatatataaaagttaagataaaggcccatattccacagcgtatataaatgcgcctcaatttaccaatctcccaacattcataagaatagggcttcagtcatgggacaatctcccgcagccaaaaaaaattaaaaaatattgccactgttctgtgagctacaagtgaaccccaaagtagtccagggattcatccaagggagaaaaatcatttaaattcggagacttgccactctccaggcattcgagcagtaccgaatcccaaaatgccgaacccttctccgcccaaatttcttgcccgtcgttgctgcattccgcttctgaaccggaaccggaggacgagaacgctgcgtcgtcttccgaaggcagccggaactcttctgaggcgaacttggcggcggaggctagaatttgcggcggggatagagaagaggcgcaggggatttccggcggggtgtggggaaaattgagcttggcctttgatcctctcaggcaacagacggcaaagtcgtaggcgcgggcagccttttccggagtgtcgt

SEQ ID NO: 17152 - DNA, 746 bp, Picea glauca
  Predicted polypeptide sequence is orthologous to G2298
ttttttttttttttttttgaggatccatattttagtaattatataaacactttcgtgaggatcaggggtcttgaaaattgatccccaatagtttacacgtctgtattcatatacatattctttaatgtaataaatatatatacataatacactccactgggtaaacctacctaaaaattggaaaaatatttttgacgattgggtcaaagcctgttgcctgcccgacgacgcaaccaaaaaggggttttgcgactggtgggaatttgagaagtggaatgttcgtttcctcatcttccctcaaagtaattgaaatgtctcagaagtttcacaaatctgtggggtcggagaaaatgtaatcctcttgctgctgctgctcctcctgccaagttggaatgaactccaacaccgacgcctcctcaatagacgggattttctccaaattcaggccgccattgccgtcaaacggagtctccaacaaccccaagtcctgcgccttggaaatctgccgactgtcatatgaccgcgccgtttctgaaaccagagacaattgtgattgcgatgccggcttctccctcgccttgtgatcattattttttatactctgcagagagtgcgaagtcgaaggtattctgtccaaggcatatttggcggcggcaacctgaatttgctgacgggtaagagaagacacggacggaatggaggtcacggaaacgggaaagttgaatttggcgttggggcctctcagg

SEQ ID NO: 17153 - DNA, 856 bp, Picea glauca
  Predicted polypeptide sequence is orthologous to G2311
ttttttttttttttttttgtgaagtgaaaatgtttattccatcaaaaaaagagacatctatgcataacatcgtaaaaccgaggacaaaattctgtacatagttgcattcctgaatcactgaaaaggacttgcgtacatagttgcattcctgaatcgctgaaaagggcttgcatagtgtttggaaattggccgcaaaacatgaatttcataaagaaaaaccatccgcgtcatctgggggcgagaattgtccaaacacctcagatacagctttaagaaaaatatctgcttcctctgccaatcttgtatcatactctgcttctcttgctgcttcttctgccgaggcagccatggcgtctgcttcggccatcttcatagcagcagccatggaagcttgatttatcgtctccagcgaagcagcatccatgggcttgtaccataattgctttaaaccatcggctgaattccgaggtcctaaaactgcagctctcggttctcccatatccttgagcttgtagctattacgaatcctgatgatcttttcctgggagactaagcgcttgagcttagagccgagagttcgcctaaaacttgggggtaattggtgtctttcctccatgaaactcgcaatcgtagtaacgtctattccattcggatctcgcagagccgtgagggcttctaaaatcatgtcatcataatcgcacctcggcgaatgatttctagcacttgctgaaatgctcttaggagagtaaataacaatatctgctgagggtattgttgcttcggattttacgagcattccagcagcaggagctgtgggagaaagtggggaaactgaggaaagaggcacagcggcaat

SEQ ID NO: 17154 - DNA, 824 bp, Picea glauca
  misc_feature (789)..(794): n is a, c, g, or t
  Predicted polypeptide sequence is orthologous to G2382
atttccgagaaaaaatacaagatatttttgaagcgaagcatttgttaaggtcactggagatattcattggctgtttataaaaaagaaaagtcgcatttttgttgtgttctgaactgaagccctcgaatatgtggataactgcagaacttctttgtaagaatatcctgaaaaagttctatccaagaaaagctgaatggctcaaccagcagaaccagccaacaaaggtatatttcaagcccagttcaaaatatcatgggaaggaaccgagtgtgaatggggaggaagacattatatctaataaggaaagcccagcacagctggctgcggcctttagtaagccccctatgcctcccttgttcggccccttctttgtcttctctattctggaaatgctacttcatacagagaagaaaaacgaatgattttctacccttctatttggttgcaatggccccagattgtagcccacatcgataatgtatatagagttcagcttcttgtgtagatatcgattgaggaacgccttatgaatttctatatgaatctgtatcttcttgaggggaggattttgctgattgatgatgtctgttctagtcacagaaataaacattgcaatggggtttgtatttttgagtgttgaattaagggcgagaccttgcaaaggtgctgttgtttaccttgttatgattatattttaaatagaaaactcctcctctattaaatcctgaagatagaaatgaaggcacctgatgagattggaacattaggcttaattgtaatctttacatnnnnnngattgagtaatttgttgctgaatttatctg

SEQ ID NO: 17155 - DNA, 838 bp, Picea glauca
  misc_feature (801)..(801): n is a, c, g, or t
  misc_feature (805)..(808): n is a, c, g, or t
  misc_feature (810)..(810): n is a, c, g, or t
  misc_feature (812)..(812): n is a, c, g, or t
  misc_feature (814)..(816): n is a, c, g, or t
  misc_feature (819)..(835): n is a, c, g, or t
  Predicted polypeptide sequence is orthologous to G2382
atcaaccaaggtccaaaatatatgttgaagaccttcaataggcaagtatttacagaggctacagtgccttttgggagatgaatcttttggtaaaaaccggtaagggacctccactttgcctattacaaacacatttacaaaagagtcatatttgactcatgacagtagtatgcggcacgctttggcttgaaaaacattctgccaagtgcagttataactaatcgcctcacctcagagggtttccttttacagcaacttcaatcaatagcaacgatctcaaaacataaaatgagaactaaaaacaaaggagtgatatgttcacaagataaacggtaaagaaaaaagactacccagtggaagtatttaccaatgttaacattttgattttgaggtggctgagttcaggactcaaacataactccatgcttattaggcacccacgtcctcagccactcatattagtgacggaagcatcaatgtcatcactcccctgcctaattttcgccaactcaatctgggtctgctccaaaatccgtctcttctgcatctccaaatccctgtcaaattccatcctcatcttctccaaatccagcatctgctgtttcttgctattttcgattctctcataaatctccccaaatctatgaatggaatcagccaaaatcctgaaagaatcctcgtcatcctttcgccgcttcaaccccctcccctcatccgcctcctcatcctcctcatcctcctcctcttcttcttcttcttcgctgggcgaatccccggggccatcccagacctccttaaacntagnnnnantngnnnaannnnnnnnnnnnnnnnncac

SEQ ID NO: 17156 - DNA, 697 bp, Picea glauca
  Predicted polypeptide sequence is orthologous to G2455
ttttttttttttttttttatgtacacaataggtagaattacaatcggaagtctgtctgaacccaattatgatacaatccaccgcacccttgccttaattacatattgaaacaccatgctagaaacgctcaatcccgcattcgcccttccgtcaatcataggagttttctttttacatgttgtgctgtgtcttaggcattctcaaatgaaagacttttcctggcgtccgaattcctctctttccgccgtgcgtggaggcgtcagagtattgccattggcaccgcccctcaaggcaccatttgcgcttcttgaagaagtgcccttgatggaaagattttccatcattcctgtaggtggtccctgctcttctctccagtacaggtttgacgtatgagtgattgggccacggaagccgtcatcagcaggatcagacgagccaagatgaaaaggcgtggttttgcctttgaggaaagccgcggtctcgacggttggcgggtgtacccaggttgtttcagttgttggaacgcctttgtcagaagtgtattcctggtagtctccctcggtgccggaaaattgtttggcagtgaaatgacgtggaccgggagctattccggctgtcgggatcttggacagcgtctcggcaatgaaccaattctgattgtactggctggtgccggggacttcggcttcagagatcc

SEQ ID NO: 17157 - DNA, 756 bp, Picea glauca
  Predicted polypeptide sequence is orthologous to G2467
gatgactctaaatgaagttcttctgcgacatgatattttacaagaaccgcctcgccatgctttagccttacaaatggccgatctagatcgtaggagggaggcatttaagaagcacaggtcaaaccgtggattcgttaatttcttggatgaacaaaggacttaccttcaacgacaaagccatcgtatgcagagtgtgatacgttcgatgatgcagaacccttcttttcagcacgaatttgttacagccttacatagttgtgcgaaagcagcttaatcacatcttcttcaaatgtttttcatgtaaagttttcactcagaatgacagttgtaaaagtggaccgtgttgtctccttacttaggatcgttaaaatagtgtttagtgtgtggtctggactattgagataagacttgttccaatgttgggtgaaaagtcgctggatacaattaagatatcaatatctcttttaacttaacttaatctggggagcgaagaagtttccagtcgctcggtcagcttttggcatcgataatgtcaattcccatatccactcttcaatgcgttgaatcttgcaatgagatcattccccacacttccattgagaagtgtagaaactttggctatttttacaaacatttaaagcactcccttccatgtggggcagactgattaagctgcattgacacatgataacgggtcatagttttgtgattgcttgtatattttatcttctaaatttgatgcattttaaattttct

SEQ ID NO: 17158 - DNA, 875 bp, Picea glauca
  misc_feature (5)..(12): n is a, c, g, or t
  misc_feature (17)..(17): n is a, c, g, or t
  misc_feature (28)..(30): n is a, c, g, or t
  misc_feature (34)..(36): n is a, c, g, or t
  misc_feature (38)..(38): n is a, c, g, or t
  misc_feature (58)..(60): n is a, c, g, or t
  misc_feature (833)..(842): n is a, c, g, or t
  Predicted polypeptide sequence is orthologous to G2559
actgnnnnnnnncagcntgcgatggttnnngagnnnanacatgccactggtgatgaannnaaggctttggcgattgttgaaacggagaaaaaggaagcagctgttgagcctgttctatcgaaaagctcagaaggaggatctttagacagagatgcttttttagtaaaggttaatacagagaagagattggctctcgtcaaagcatgggaagaaaatgaaaaggcaaaagccgagaacaaatactacaagtctgtgtcaaccattacagcatgggaaaatacgaagaagtcatctgcagaaactcggatgaaaagagctgaggagaagttggagaagcagaaagcagcatatgttgagaaaatgaaaaatgagattgctattatccacaagcaggcagaggaaaagaaggccatggctgaggctaaacgaggagaggatatgctcaaggcagaagagtcaagtgccaaatataatgcaacaggtcaggtgccgaaaaagttctttctctgctttgggggctagcaagtttttcattacaattgctgtgaatatcttgtttgtttggatatgtagaatattgatcagaaagattgtagtcatttgactgtatttctcgaacacatttgatggcatcaagttgcacaagtcttgattagaagaatatgtattttgtagtccacttaggaatctcagtcttttgatttaagaacaaggcttcccaatgtttattgtgttgatctggattctgaagtcaggtctggttctcaagaataaatcatcatttattcatatatatatatatatatctatatatagatatatattgatttgtnnnnnnnnnngagcttccattgaacttgttccatgtattagga

SEQ ID NO: 17159 - DNA, 549 bp, Picea glauca
  Predicted polypeptide sequence is orthologous to G2565
ttttttttttttttttttcgaaatattattccatttacaacttcagaaaacagctcatgcgcaataacgagctgagaatcgtggatatccatccatcctatacagattcaagacatgactaaatatcatttacacataggcctatggactaatggtctaaattatacatttgtttaactcgtttcatcggtggtgattctatcccttctgaaattagagttgacttgtgacagggtttttcatcttctccagagttgtcattatggtctctaagcatctgtgaatcgtttccatcaactagttcagaaatgggagatgtttcggagtcacttttcctttttgttgcctccaaatttgttgcataaagaatagtctcagatgactgacaagagggatccccagaagatgcctgaggagccttaaataagggatcttttttctgtctctcttcaaacatcttctttagacgtcttccctgctcttctattcgcatttgtaaatttctttggacctcgagctgttcatgtaattgcttctgaacctccattt

SEQ ID NO: 17160 - DNA, 345 bp, Picea glauca
  Predicted polypeptide sequence is orthologous to G2571
ttttttttttttttttttgcgagcgagcagccttttgtggagaaatatactggagctgtatcttcgcaacctggacccgccattgcagtagaggagctaaaagagatgcgacagaagttcctctctgcctcactacgctcatagtcccgccatcctccgaatagcaacattgcccagcgtcctcccatcagcctcaacacccgcctcagctttcagcggcttcccatctccggcagcaagatcaatggcgactttcgcaagcgagtcgaccggcgtatgccacttcggcgcaagcaacttgaccgcgggatacaaccaaccagccatcctttccggcatcgtcac

SEQ ID NO: 17161 - DNA, 890 bp, Picea glauca
  misc_feature (811)..(815): n is a, c, g, or t
  misc_feature (848)..(850): n is a, c, g, or t
  misc_feature (852)..(856): n is a, c, g, or t
  misc_feature (860)..(860): n is a, c, g, or t
  misc_feature (862)..(862): n is a, c, g, or t
  misc_feature (864)..(864): n is a, c, g, or t
  misc_feature (867)..(869): n is a, c, g, or t
  misc_feature (873)..(882): n is a, c, g, or t
  misc_feature (888)..(889): n is a, c, g, or t
  Predicted polypeptide sequence is orthologous to G2571
ttgattatcagatgacaaaaatatgccacaatatataagctaacattctatataggtacagcaggtttctggaagccaaaagaattagcaagctaaatcctccagcctgcaaatggggctgtatttattccctatacttctagatttctagacacttctataatattaatggccatcgatgcagctacaaaacgtgcatctttggtctcagctaagagccttgactctcctactaaactgacagcttaaataaatatgcacaggaaatgtaacactatttaagaggacataacgtcctggatcacttctgggtccaaagaaggcattttggtgagacagtcgtccagttcagcgaaaatagagaaagagggcgctttctgcaaagccgatgaatcgacttcacatttgctgggtgacgtagaagcagattctgcaccacagatcgttgagctattgctgcttccagaaacttcacacttgacattctccagagcttcattgttggcagtttgtgccatcagacgattttctgaagaattttcctgggataaacgctggcaaattgcctggagctttgcatcaacagaagatttcagcacagataacgcattacccggtgatgaaagcacatttgggctaccgttatccgaatttgagagcaaaagatatctcaagtccggaaaattaagccttgcgtactcaccacgtagttggtaggctgctgtgtcatatgcaaacgctgcttcttctgctgtgtcaaaagttccaagccaaagcctggttctattcctaggtaatctgatctctgctnnnnntttcccccagtgcctctgtctcactcctctgtnnngnnnnncagncntngcnnnaccnnnnnnnnnntcattnnt

SEQ ID NO: 17162 - DNA, 507 bp, Picea glauca
  Predicted polypeptide sequence is orthologous to G2592, G2713
gcacgaggaaagaaccttctcaaccagtgacacagggtgatcctgacaaggtcatccttcaatttgggaagattggaaaagatattttcaccatggattattgctacccactctctgtatttcaagcttttgccatatgccttagcagctttgatgcaaaattggcctgtgaatgatacacagtaaaattttggtgctcggtaaaagaaattgtaacacatcccctgcttagaagttttgagtggcaggttgctggaatgttttaaaatgtaacacattccctgggtaggatgtctggataagacattgggagttttaagcatggtaaaactctcagctataagctttgaaattatcaaagccctaattgtgttctgccgagttttctgatgctccatattctgttatgctctttgttatacggattaggaggattagtagaatcctaactccaataatttaatgactctgctcaattgaaaaagaaattggatatgcatttgcttt

SEQ ID NO: 17163 - DNA, 830 bp, Picea glauca
  misc_feature (665)..(666): n is a, c, g, or t
  misc_feature (731)..(732): n is a, c, g, or t
  misc_feature (735)..(736): n is a, c, g, or t
  misc_feature (755)..(755): n is a, c, g, or t
  misc_feature (757)..(762): n is a, c, g, or t
  misc_feature (767)..(768): n is a, c, g, or t
  misc_feature (779)..(781): n is a, c, g, or t
  misc_feature (783)..(784): n is a, c, g, or t
  misc_feature (793)..(801): n is a, c, g, or t
  misc_feature (826)..(829): n is a, c, g, or t
  Predicted polypeptide sequence is orthologous to G2592, G2713
tatgattattataaaacaaatcagtatgcactattaagcatttgagaccctttaattctttctaggcatattggtcaccacatatgatcaaccagcatcatgatagtccctctattcacaagccaacttagtatcgaaactgctaagacagatggcaaatgcctgaaaagctgacaggggatatcggtaatccatagtgaaaacatcctttccaacctttccaaactggagtataaccttatcctggtcactctgagagacagattgtgcaggctcagtagatgcaacaagctgaaagttctttacagatgcaactgtcactcgtcctcgaaaattcaaacaccagcattgaagctgctcatgccaccttggggctttgtttttcaagatcaatggatcatctttcaagttcccactattgagaggaccagaagaagcactactttcactaatgactgacttggagcgagaggaacggaaagatgctagaggctccactagagtacttgatggaatttcaacagttgaactgctcattcctgcttctatggctgatgctggtatagaatgcatggtacattgcattcgccttggaccccttgtacccaaaacattcaattcataggcaatgtgagcaacattatagctactagctgggactcttnnagaaacttgttttgaccccacccgtcgccctgcatgacttgttgcaacaccaccactatgaggannatnnctatcatatattgtgaacntnnnnnnaagannatttgatctcnnntnncctacatannnnnnnnntccccttgacatatcctctgcgtcnnnng

SEQ ID NO: 17164 - DNA, 779 bp, Picea glauca
  misc_feature (4)..(7): n is a, c, g, or t
  misc_feature (18)..(24): n is a, c, g, or t
  misc_feature (29)..(31): n is a, c, g, or t
  misc_feature (41)..(43): n is a, c, g, or t
  misc_feature (45)..(47): n is a, c, g, or t
  misc_feature (193)..(193): n is a, c, g, or t
  misc_feature (280)..(282): n is a, c, g, or t
  misc_feature (678)..(678): n is a, c, g, or t
  misc_feature (683)..(683): n is a, c, g, or t
  misc_feature (747)..(749): n is a, c, g, or t
  Predicted polypeptide sequence is orthologous to G2592, G2713
taannnngggaaggacannnnnnnaatgnnntatagatatnnncnnncagccttccaggcatttgcaatatgcttgaccagctttggtactaaacttgcttgtgaatgagctgtatttgggatgtagcttctcaggaaagaaaaacataattgataacaatgatttggggttgcttatgaagacgtcagtcanctgatggtttaatgaagggtgtaagcaagattattctctagaagcttgctatagggattttattgcccatgttttttcctcagaaannncagttaacagagaaagtgttatgtatttgtcctagtataaactgtaatattatcaaattgtgaattagtgggtcccgtcgaggttaattttctggagacctcatctgcaccatacaccagagttccaggttcctaggaaagctgcatttgctactgttttgaaaactctttagctgatgattgggattgaagtggtttatgctttaagcttgtacagatcacctggaagattggttcttcattcatttggtagcttcaggagaagaaaaaccataggatatacactatccttcttggtagaacataattgtatagcttctggtttaaaccagctgcagactaacagttccgaaagtttgcatgcccaaactgtggttgtatcaacactggtaatcncttcnctaccttattaacacagtgcagcatgataatgagttgtagtagttgtgttggtgattgaattgnnnaagaggtttgaagcatccatatttgctgca

SEQ ID NO: 17165 - DNA, 910 bp, Picea glauca
  misc_feature (839)..(846): n is a, c, g, or t
  misc_feature (848)..(853): n is a, c, g, or t
  misc_feature (857)..(863): n is a, c, g, or t
  misc_feature (865)..(865): n is a, c, g, or t
  misc_feature (878)..(878): n is a, c, g, or t
  misc_feature (880)..(887): n is a, c, g, or t
  Predicted polypeptide sequence is orthologous to G2592, G2713
cttatgttggaaaactgaggtcaaactttcttggtactaagtttacaatatatgatagccaacctcctcacagtggggcaattgcatcaacaagccgtgcaggtcgacgggtaggagcaaagcaagtttctccaagagtcccagctggtagctataatattgctcacattggctatgagttgaatgtcttgggaactaggggtccaagacggatgcaatgcatcatgcattctattccagcttctgctgtgcaaccaggaggtagtgctccaactcctgttgaaccttcgatcactagtctagaccattctcttgcatcttgtcctacctttggctccaagtcgtgcattttagaaagtccatctatctctgaaccacttaccaatagcaactcgaaagatgaaccgttggttttaaaaaataaagccccaaggtggcacgagcagcttcaatgttggtgtttgaatttcagggggcgtgtgacagtggcttctgttaagaattttcagcttgttgcagcacctgagcctaatccatcagtttctcagaatgattatgataaggtcatactccaatttggaaaggttggaaaggacatgttcacaatggattatcgctacccactctcagcttttcaggcctttgccatatgccttagtagttttgacacaaagcttgcttgtgaataggggaagatcagtcagtctggtgacaaataggctcatattgatgcagtatagttgcttagaagtctgaaggttgggtcgtattttgtataatcatcagtgtttagtggtggttagctactagttaccacaatttataacactcttgagctnnnnnnnntnnnnnnaagnnnnnnngncgtctgctactcntnnnnnnnncctgtatactaccagtagcagct

SEQ ID NO: 17166 - DNA, 929 bp, Picea glauca
  misc_feature (815)..(815): n is a, c, g, or t
  misc_feature (817)..(817): n is a, c, g, or t
  misc_feature (873)..(879): n is a, c, g, or t
  misc_feature (884)..(886): n is a, c, g, or t
  misc_feature (889)..(899): n is a, c, g, or t
  misc_feature (916)..(922): n is a, c, g, or t
  Predicted polypeptide sequence is orthologous to G2592, G2713
gttgaaacagcctggaccacgtgatgcacccatgcaatgttttatcaaacgggatcgggcaacttctacataccacttgttcctgggcctaagtcctgctttgcttgttgaaaatggaaaattcctctttgctgccaaaaaagttagacatgccacaagcacagattatataatttctttgagtgccgaggacttttcccgagcaagtaacacatatgtgggaaaattgaggtcaaacttcttgggtaccaagttcacaatatatgatagccaacctccgcacagtggtgcagtagtcttaactagccggccaagtcggagattttattccaagcaagtatctccaagagtaccccctggcagctataacatagcaaacattgtttatgaactcaatgtccttggtactagagggccaaggaggatgcagtgcacaatgcattctattccagtttcttctattcagtctggaggaaatgctccaacaccgacagaatttcctcgttcattggatgaatcattttccttacccttttccaaagaaccccttgtagatttcagcagctctagcttatcagaaattccaatcaacgttgagagcaaagatgtacctcttgtattgaaaaataaggcaccaagatggcatgagcagttgcagtgttggtgcctgaatttcaggggacgtgtgacagtggcatctgtaaaaaactttcagctcgttgctgctgtggaaccttcgcaattggtgacacaagctgaccaggacaaagttatccttcagtttgggaagattggaaaagacatatttaccatgnantatcgctacccattgtctgctttccaggcctttgctatatgcttaagcagctttgnnnnnnnactgnnntgnnnnnnnnnnnagttaccttggtccatnnnnnnngctcatt

SEQ ID NO: 17167 - DNA, 837 bp, Picea glauca
  misc_feature (3)..(6): n is a, c, g, or t
  misc_feature (17)..(17): n is a, c, g, or t
  misc_feature (33)..(36): n is a, c, g, or t
  misc_feature (65)..(71): n is a, c, g, or t
  misc_feature (84)..(84): n is a, c, g, or t
  misc_feature (86)..(86): n is a, c, g, or t
  misc_feature (799)..(805): n is a, c, g, or t
  misc_feature (832)..(836): n is a, c, g, or t
  Predicted polypeptide sequence is orthologous to G2702
agnnnnatccattcccnacactcaacaaccgcnnnnacacatgggaaggagtcgggtttttcacnnnnnnntcaggcattgcancngtcagtatgggagatgattcaagttatttgaatttggagcatgcaaaagtgggacttttaggaagcgagttttctgttcccccactagctagtagcacaaccaccaccgaggagaataattacagatccataggttgcggcatggatgggaaaggggagaacagcttctccaataacaatgatagttgcttcagcaatactactactgccagttttaaagcggaggacgacatgtctgggtttgggaataatttgcaagcggctaacttgagaatcggggaatgggacctggagggtctgatggatgatttgccctccttcccttttcttgatttctaactcccattttccatttttttcccaccccggaagctaaaaccgcccctctctctctctctctatctctatctcgacctacccatcaattttccttttacagaataatgaaagaacaacacacacatactagagaagtttctgtttatactgcatgtttcataaaataagtctcttcctctctcccatataattccctcagcggatggagattctgtacaatgatctctcggatattggagataacagcaacggaagcttgaattgcaactgtgagataatgcaagtttacgtatcatttgtttcatgtacatcagtttcatatgaaggtttcttagtagggaagggcgttgttgagaaatgtgaatattactccnnnnnnntaggaaggcagaataaaagttagtttnnnnna

SEQ ID NO: 17168 - DNA, 807 bp, Picea glauca
  misc_feature (99)..(101): n is a, c, g, or t
  misc_feature (592)..(594): n is a, c, g, or t
  misc_feature (610)..(611): n is a, c, g, or t
  misc_feature (628)..(630): n is a, c, g, or t
  misc_feature (690)..(691): n is a, c, g, or t
  misc_feature (718)..(718): n is a, c, g, or t
  misc_feature (726)..(727): n is a, c, g, or t
  misc_feature (729)..(729): n is a, c, g, or t
  misc_feature (776)..(776): n is a, c, g, or t
  misc_feature (778)..(782): n is a, c, g, or t
  misc_feature (798)..(799): n is a, c, g, or t
  Predicted polypeptide sequence is orthologous to G2717
cattaatgaatgctgaagaggctgctaaaactgctgctcaagcagtggctgaagcagaaatagctattgctgaagctgaacaagcggcaagggaagcannngcagcagaagctgatgcagaagctgctcaggcctttgcagaagcagcaatgatgactctaagaaattctcgaaactctgtcagaatcttgagatgaaagtgcacgagacaacagtgtatcatttgcaggtggtcgtccaagcaatggaaaactgacaatggtgaactagtgaaaggaaatgggaggcaaggctttttcttttgcatcggttacatcccatcaagtttaactttttacatgccatttgaccaaaagacttcaggaaatctatcatcatttttatcttctcgggtttaatgaaagctgttaataggccaccaatctgagtaagaactgcatccgtcatttttatggctcggcattgttgaaaccgtctaaagaagcaacatctcatcatgattcttggttatcaaaccgggacactataattcaaaatgattgccttctggacagtagatgtattacttgattgccttcaagtttccgtcttnnngaatgctatgattccnnctggatttgattttcannngaaaaaatctttgcgttcaaggattctgctttcaagagaaatatatcatttttagctaannttagctattttcttctgtgtttcagtngggactgnntnatagagcttcctttatcctattatggatgctgaatattacaagactntnnnnnaaatgtattatgactnncactttgt

SEQ ID NO: 17169 - DNA, 633 bp, Picea glauca
  misc_feature (619)..(627): n is a, c, g, or t
  Predicted polypeptide sequence is orthologous to G2754
gaatgagacaggcaatgaagaaactgaagataaaaaaaaagttcaagtaatatcaaagttgcatgcaatccttagaccttttcttctcagaaggttgaaagaagatgttgaaaagaaccttccttcaaagaaggaaataatattatatgctcgtatgactgaagatcagagaaaaatccaagagcatctactaaacaaaagtcttattacatatctacatgcgaggtcgggaaaatctagttgatgaatttgggaatttgtattactggtacatcttccgaggcaatgtatttgaagattcttctgtctacctggtaataattttagtcaattgctttgttagttctgctcctctcgccctttttatatcctatttgcgattcttcgtgtaatattattttaccagtttcatctggaatctagagcattaaatgtaataaccatgtagttgtactattacacgttggaaagaagaaggcatgctactttgtctgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnnnnnnngggggg

SEQ ID NO: 17170 - DNA, 825 bp, Picea glauca
  Predicted polypeptide sequence is orthologous to G2777
ttttttttttttttttttcgagctctcaccaatgaagcaatcttatattataataatcaaatcgatctttataaaagaataattaaagcatgaaaaccaaaaccatgaatcaaatctaagaatccctttctctttcgaatcctaatgactactctaattctttgctccatatctactgtaattgaatcctcatgaagagagagcactctcttttatacatgagagccttgaagataagataaccatctcataattatagatccactattctttcaacctatttcccattattacaaaatataatcccttcaaatcctcacacatatctctcatatatcttggataagatattccaaccaaatctccatgatcttctccttgtaatgggcttgaattatctcctcaaatcttgaaatggtggaggaagtattcgagaagtccttttgaattaatccttctcatattcctcgaatcacttcgcccagctacctctgcttttttatttcctcgttccttcgctgtctctcctcctacaaatgggaggtcccgctctttggtgttcagtctggttcagtctgaattcaaaggatggctgtgggcttgaagtgataagtggatggaaaaacgagttttaatgactgatagggtttgtgaaagttcaccgcttgtgtgagatgtctgattttcactgacatatcatccaatatgtgtgaggctgcgtctttcggtctcttgccaatttctaattcggacggatatatcgctcggtcggcagcaacatccggcgactcgcgagtcgccattaccttgttacctctgccattc

SEQ ID NO: 17171 - DNA, 877 bp, Picea glauca
  misc_feature (13)..(14): n is a, c, g, or t
  misc_feature (49)..(56): n is a, c, g, or t
  misc_feature (756)..(756): n is a, c, g, or t
  misc_feature (843)..(845): n is a, c, g, or t
  misc_feature (850)..(865): n is a, c, g, or t
  misc_feature (872)..(874): n is a, c, g, or t
  Predicted polypeptide sequence is orthologous to G2789
ttggttgaactgnntgccaaattcagacgggtcaaccgttacaaacaannnnnnnncagaatcatacaacttattctggtgagaaattatacaaggcaaacaagcttggaaagcaaatctttttcgttagagctgagatgctctattttctccttcctgttcgagcggaacgatgatgacgaggaacgaatttattgcccaacccaaagtctaacttgccctgaaaagggtaaagcacagcacaactctgaatattgtttgtacacctaattatgaatgagctgacctcttcgtgtgggagaagccaagtgaccgcggggcaaaggcgaacaagaatacttgtgctaatagggagtatgggcatgctgtgcccaggcgtaggcgtcatgagccagttggccgttggtgagcagactggggggaacattgaaggtgggcatggtggacggatcgggcatctgctgctgctgctgttgctgctgcgccgccgccgtcatagcggatgattgagagagtcctccagggcgctggagctgcatcggcatcggcatcggcatcggtccctcgtcctcatcgaggggcagacgttcgtagggggagttacggaatgtggcagccgttacgacgactggaccggaggccaccagggcgcccacaacgctccctcccactacttgtccttgtccgccggcgagatagattgtgaggcctgtagccccgggcggcacaggcggtggcaggaacgaaccggacagngataggatctcgaaccgtccgtgcaaggtcacaatcgcgctaggtgcggcagcctgcctcaggttaacattcatcaccatgccgctnnngctgnnnnnnnnnnnnnnnngctgccnnntgc

SEQ ID NO: 17172 - DNA, 879 bp, Picea glauca
  misc_feature (13)..(19): n is a, c, g, or t
  misc_feature (22)..(22): n is a, c, g, or t
  misc_feature (24)..(24): n is a, c, g, or t
  misc_feature (46)..(54): n is a, c, g, or t
  misc_feature (56)..(56): n is a, c, g, or t
  misc_feature (58)..(60): n is a, c, g, or t
  Predicted polypeptide sequence is orthologous to G2790
cgggctgcaggannnnnnnacnangccggagggagcccctccagtnnnnnnnnnanannntcaagcaataataatttgccaaaaaatactgttgatgaaggtggagagtgcactactgaacaaaagagaaacagcgatcaagcggggctttccaacacagctttcaagaaacctagaacagaagcttctgcgggcgctccgatgaaggtgcgcaaagagaagctaggcgaacgcattacagcgttacagcagctcgtttcgccgtttggaaagaccgatacggcatccgttcttcttgaagccatgggatacattaaattcctacaagatcaggttcaggtattgagctcaccttatctcaaaggcattccctccaatcaaaaggatgggcgaggagatcaggcgaaatacgacctccggagcagaggattatgcctggttcctgtatcatgtactctccatgtagccaacaacaacggggcagatttctggacatctggaatcggaagcggttccaagttttgacatcctgcaaccccttttttttggtttttcttttcagtctgttcctgcgtttttcaacggaacagttgtcacctttaccacataaattcaaagctaatagtagaaaagcagaaagatgaggacgggacgaaaagcagtcccgtcctcgatgtcccatttagattatgattctctgtgatatatataaaatatgtatatgtctgtctgagaaaagcagatgcaacctgcaaagatgctatactgcttttccccctttatctattgacgccattttgcactttctgtgtatggctgtgtattgacaatgatgtgacgaggccaaaaacactaaagaaaaagcaaatgcgtttgtta

SEQ ID NO: 17173 - DNA, 913 bp, Picea glauca
  misc_feature (804)..(809): n is a, c, g, or t
  misc_feature (858)..(862): n is a, c, g, or t
  misc_feature (875)..(882): n is a, c, g, or t
  misc_feature (886)..(893): n is a, c, g, or t
  Predicted polypeptide sequence is orthologous to G2791
cacaggaggcagctgtaacggcagcgacggaggaatgcttcctcttcctctcagtcttggtcaggctggaaagtccggcgacatgaacgagcccggatcgcgggaagaaattgaagcttctttcaagtcggtaaataatgcccgagattcgaacctcggagggctattccagccgttcgccgtatcaccgcggggcgttcgaccgaccggtcaaaacttccatgcgcagcccggacaagtgccattgcaagggtatggtggaatgccccaacctcagcatcagaatccacctccgaccggagttggtgctgcaccacctgttcgacctagagtaagggcacgccgtggacaggctacagatccccacagtattgcagaacgattgcgtagggagaggattgcagagagaatgaaggctctgcaagaactggttcctaattccaataagacggataaggcttctatgctggatgaaataattgattacgtcaagtttcttcagctgcaagtgaaggttctaagcatgagtcgactgggaggtgcaggagcagttgctccccttgtggctgatatacctgctgagggtgccaacgccccacaaggcacaagaaccaacggtagccagaactcttctccggacggtctagcattaacagaacgccaagtagcaaagctaatggaagaagacatgggaacggccatgcagtatcttcagggaaaaggtctctgtctgatgcctatatctctggcctctgccattaataactccggttcgagaccccaggctccttccaccccttctcnnnnnngactattggcatctaatgttaacgacaggcaggtactcgaaccctcctnnnnntcggcactatctnnnnnnnnctcnnnnnnnnatgacatacagccatccatc

SEQ ID NO: 17174 - DNA, 715 bp, Picea glauca
  misc_feature (705)..(705): n is a, c, g, or t
  Predicted polypeptide sequence is orthologous to G2802
gaaagttctgagtgcagtcctctttggcatcctggcaatctagaggtgggtttgcgtttgagtaaggagaaccagctagttcaagcttctgatcatgctggaatgcaccctaatattattgaggactgggcctgtaagcttgaagagtccaagaatggttacgttggtttggacgagcatcatataacgaggctactccagtgccatgaaacacaaatggacggcatttcaaacgcaaatccactctcatatagcacccaggaattgaatgatatagcagaagctttaggtttaagccttaacgatcaggaagggtctgctcagaaaattgatagacaattggaggacatttttatgtatccgcctcctgagctgcagaaaactttgtcaaacagtcaagaagctgattggctcgagtactccttttgtccagattcttataatggctgttcccactatggaggaccgatttgatttagaaggcacactgtgttgtactgtaaacagtagtccaatgacgttgtccattgtttggcatttaagaaagcggtatttggcgcaccagcaccgagagcctcagcataattttccagagaagcgttacacatttatttttgttcactgtaaaaagctgcattatcctcgctccctgcgagattgttgtatacttctgactatctattgaattgaaaaacacaaaaaagntttccgacgt

SEQ ID NO: 17175 - DNA, 790 bp, Picea glauca
  misc_feature (4)..(9): n is a, c, g, or t
  misc_feature (24)..(24): n is a, c, g, or t
  misc_feature (29)..(29): n is a, c, g, or t
  misc_feature (33)..(34): n is a, c, g, or t
  misc_feature (36)..(38): n is a, c, g, or t
  misc_feature (73)..(75): n is a, c, g, or t
  misc_feature (142)..(143): n is a, c, g, or t
  misc_feature (457)..(459): n is a, c, g, or t
  misc_feature (609)..(611): n is a, c, g, or t
  misc_feature (760)..(766): n is a, c, g, or t
  Predicted polypeptide sequence is orthologous to G2834
aaannnnnncaagcgctcatgtcnagacnctcnncnnncgacaagtcctgtccagactccccgaggaggtatnnntgtccgttcgagagatgcaggcggaacaagaaccaccgaaagttcaagccgctgaaatccatcgctnntttgagaaaccactacaagcggagccactgcccgaagatgtatacctgcaacaagtgcaacaagcagttttccgtcgtcggagacctgaaaacccacgggaaaaactgcgggcacaaccgatggcagtgctcctgcggcaccacgttcaccaggaaggacaagcttttcggccatgtcggcctgttcgaaggtcaccggcccgtgcttccttccggcgaggccgcggctaaatcagaagaagaaaacagaaccccgggcaacggaaatcggccggatttttttgtgggagatccggcaggggttgttaataagnnncagagctatggcaattcatgcagcgatgagcagctctttcgcgcaggatcgagccagcaaaacgacatcgacggtaggttctgtcagtccgacgtcttttgggctggtttctcagggtagtttgtttggttaaatgcaaaaatgttcttnnnccggtgccggggaatttttgttttgggattttcgaatagtgttttctttgtgtgggggactggtcaatacaaggccggccatgctttgatatatatgcaatgtatatgtaaatatagtgcgcggaccagcgctgtctgtatttttcttnnnnnnnaatttaatatagagtttcgttact

SEQ ID NO: 17176 - DNA, 891 bp, Picea glauca
  misc_feature (3)..(6): n is a, c, g, or t
  misc_feature (779)..(780): n is a, c, g, or t
  misc_feature (842)..(842): n is a, c, g, or t
  misc_feature (845)..(848): n is a, c, g, or t
  misc_feature (850)..(850): n is a, c, g, or t
  misc_feature (856)..(857): n is a, c, g, or t
  misc_feature (867)..(879): n is a, c, g, or t
  misc_feature (881)..(886): n is a, c, g, or t
  misc_feature (889)..(890): n is a, c, g, or t
  Predicted polypeptide sequence is orthologous to G2846
ttnnnntagtacctatgaacattgacataacctataagggaaagaagttgctggttcccctttggaaagctggcaactgatatgccttaatgctgctgcagcttattgcgcagatacagtgtctgtaacctctgagagaatttaagaggtgtaatctgataataccatcaagctgtgtgtccagcaaaaagatttaatcattttgtatgatacagctcttgagcgagaaaaaagcttaccatcagcagcaggaatcactctgatatgatgacttttagttgaacacagaagcttggcttgtttggtgtattggttacatgatgctgcagtaaatctgatgtattagattaagctgtaacagtctagtcttttatctgtaggttcccccaagcgaaggcgtccagtaatccgcaccattgtcatttgcaacgtgcaaggtgcaagatacgggaactaggcatagccctctactcctcagatcctgctttggttcatccgaatccttcttatcagacgatccccaacctttgtgatcttggctacccggatttgatgtgcccccactcttcaaatatggcgtgctcaacacctgtacttgatcctgtaggaacttgatatatccgatggcttccagcaaaacagatgcagtgtcagtcttgccaaaaggcgaaacgagctgttgtagggctgtaattcggtccccgagtttctccttcctcaccttgaacgtaggaagcgttgagccagtatctagacggggccttttaaatattgcttcnnctgtgctctgatcagtgcagctgttgttcctctttgtgtcactgcttgaatctcgagcttcntcnnnntngggcanngttcgatgtnnnnnnnnnnnnngnnnnnnctnnc

SEQ ID NO: 17177 - DNA, 872 bp, Picea glauca
  misc_feature (4)..(5): n is a, c, g, or t
  misc_feature (755)..(757): n is a, c, g, or t
  misc_feature (766)..(767): n is a, c, g, or t
  misc_feature (806)..(808): n is a, c, g, or t
  misc_feature (810)..(810): n is a, c, g, or t
  misc_feature (820)..(826): n is a, c, g, or t
  misc_feature (841)..(842): n is a, c, g, or t
  misc_feature (847)..(850): n is a, c, g, or t
  misc_feature (860)..(860): n is a, c, g, or t
  misc_feature (862)..(869): n is a, c, g, or t
  Predicted polypeptide sequence is orthologous to G2854
aaanntgtgacatgattacgtatacaggtcatcacatcagcaatctagataacaaaattcatcaaaccaaatgactaccacctacaatatgttcgtacaagcaaactattttatataaatggtgccctagatcaaaatatggtgagacaagatacccacaacgtgttcatacacgcaaactattttataacaataatgagatttcctagctctcaatgtggtgacacgagttctattgtcacaagagacctcctctccattaaatctagtatagataaattgatcggatgccccgttaaaacaacttttacaaacacctctaataatgaaccgatatttccacgtccacaaaagagcctgaacccaagtaaatgttactgctgctgataatttccatatgcataaggagcataactgtacatatttggatcttgaggttgtggtgcataaccataacctgcatcatatccttgtccataaccataataagccgccccattccattgatttggatctggttgttggggttgaacccaccctggagtctgcacttgtttgtttgcaggacttcgaccccaagaaaggcgaattgcttgctgaccaagaactgtgccatgtagcatttgcaatgcttcctctgcagaagccctgttgttgaactgaacaaatccacaacgtttgcccactggtattttgacatgcacaagttctccaaactggccaaataactgtctcagcatttcgtctgtcacagnnnggtctaagnnacccacaaatatagttgtattatttggatcattatctgnnncnactacttgannnnnnnctgccgctgctttanngtatnnnngctgaaaacntnnnnnnnnctt

SEQ ID NO: 17178 - DNA, 929 bp, Picea glauca
  misc_feature (3)..(7): n is a, c, g, or t
  misc_feature (49)..(56): n is a, c, g, or t
  misc_feature (881)..(884): n is a, c, g, or t
  misc_feature (886)..(886): n is a, c, g, or t
  misc_feature (898)..(904): n is a, c, g, or t
  misc_feature (910)..(918): n is a, c, g, or t
  misc_feature (920)..(920): n is a, c, g, or t
  misc_feature (923)..(923): n is a, c, g, or t
  misc_feature (926)..(926): n is a, c, g, or t
  Predicted polypeptide sequence is orthologous to G2854
cgnnnnntatgcgtattaatgaagctacaccaaaaaagtccttgggatnnnnnnnncgtattccatgaaaggtaactattacacacaggcatatggcggtgcagttgctggtcaaggcttccagtcagacaacgatccaaataatacaactatatttgttggtgggttagatccaaatgcaacggatgaagatctgaggcaggtttttgggccatttggagagattgtgtatgtgaaaataccagtgggcaaaggatgtggttttgtacagttcactaacaggtcctctgccgaggaagctttgcaaaagttacatggtactattattggtcaacagtctattcggctttcttggggccgatctccagcaaacaagcagactgcaagctggggagtgcagcctcaaccagatccaaatcaatggaatggtggtggagcttactatagttatggtcaaggatatgaagcttatggttatgcccctccagcccaagatccaacgatgtatggttatggtggctttcctggttatgggacttatcagcagcagtaaaaatgcatctgaaaggtgctttaagcgaatgaatgttgtgcaaattgccaacttttgtgagcgccatatgctcttgttataaattgcaatgccatcagtataattcattacaaaatgcatttgggatggtgataaatttggtctacttgggtacatggtagcagaattaaaaggctgagatcagcgtaaaaactggcagtgcaaatgcagagaattgatcttgatgatagataaatagaaggaaaaccgcggcctttttctgtgataggattaaatgcattattgataactttgacatgaatctgttcatgtcatcaaggaacaggannnncnataactggacannnnnnnttgcannnnnnnnntnatnttnatt

SEQ ID NO: 17179 - DNA, 744 bp, Picea glauca
  Predicted polypeptide sequence is orthologous to G2964
ttttttttttttttaaaattaaatcaattaactaatcaaaaggttaaaaaatacttcttaggcatgcaaggattcacctaaacaagacagttagaccgaacaacactactcttctcttgtagtaagtctacatctgccttaatagtgattgtgtatccaaaaacaaaacatataacaaagtattcaagaaagatttctacacaatcgagtttctgagtggatcaggacccggcagattgctcccgcagctcatttgcaccatgtgcaaagttgcatctatccccaaaagtgcatgtacccttagcataattttcacatagcttagttttgcgattctgtacatatggttttgcagattggatctcattgtgcataatcaactcacggaccatggctgtggcttgttttatctggtcaaatgaaccttcgagctcgatattcttcaaattaggattagactcattttcttttataaacatttttgttccagttatgcggaaaatttgctttgtgtttacaccacctttaccaattatacaactagcaagagaagcatcaatactaatttttgctgttgatgaagcaccaaaatttgccgcagcagctgtaccaggaggaggatcacggtatagtgaatgtcctgaatcaacaccagaggcagccatgctgctataaggacctgctattcgctccctgtcaagatcttttgcaagtacatttccctttctcagttccttctctcca

SEQ ID NO: 17180 - DNA, 903 bp, Picea glauca
  misc_feature (3)..(5): n is a, c, g, or t
  misc_feature (7)..(9): n is a, c, g, or t
  misc_feature (11)..(11): n is a, c, g, or t
  misc_feature (19)..(22): n is a, c, g, or t
  misc_feature (24)..(28): n is a, c, g, or t
  misc_feature (30)..(30): n is a, c, g, or t
  misc_feature (37)..(37): n is a, c, g, or t
  misc_feature (41)..(41): n is a, c, g, or t
  misc_feature (59)..(59): n is a, c, g, or t
  misc_feature (74)..(79): n is a, c, g, or t
  Predicted polypeptide sequence is orthologous to G2964
agnnncnnnantaaatgcnnnnannnnnangacacgncttngtagtaattataatactngagaaggatgtcgannnnnngacaagtgtcattttgcccatggcgaaaaggagcttgcgaaggtaaatgcacctgcacacaatctcaaagatgattgggcaacaggaccttttggcagtaggttcccagttggtggcttagatggaaagcctgtaggccgtcctggctatcgtgaggctactcctcctggtatggcagctgctgctacatttggtgcttcggcaactgcaaaaataagtgttgatgcggctcttgctggccctataattgggaaaggtggtataaactctaaacatatttctcgtgcaactggtgcaaaattagctataagagatcatgagtctgataccaacctgaagaatattgagttggaaggtagttttgaccagataaaggaagcaagtgccatggttcgtcagctcatcatgcacacaagtgctgtactgcctgctgcaaagcagccttcgtttactacaaacaatttcaagaccaagctctgtgaaaactatgcgcaaggcacatgcacatttggggatcgttgccactttgcacatggtgccagtgagttgcgagacaactctaaataaatctgattttctattctcttccttcctttatgggtatattctagaaagtactgtatcacaagttttgagccagggattgtagatggtgaggattagtaattacttcatgtttatttaaactgctacgggcttgcttgaacttgggcatggcctgttgtagggtgaagtccacactatatttcccaatttatttgatgaaaacaattctgtataactgaaagatttgtgcaagtagatgccccttttttttaatttta

SEQ ID NO: 17181 - DNA, 880 bp, Picea glauca
  misc_feature (2)..(10): n is a, c, g, or t
  misc_feature (57)..(60): n is a, c, g, or t
  misc_feature (776)..(776): n is a, c, g, or t
  misc_feature (799)..(799): n is a, c, g, or t
  misc_feature (853)..(853): n is a, c, g, or t
  misc_feature (858)..(859): n is a, c, g, or t
  misc_feature (864)..(868): n is a, c, g, or t
  misc_feature (870)..(877): n is a, c, g, or t
  Predicted polypeptide sequence is orthologous to G2989, G2990
gnnnnnnnnnttactcaaggccaaatggcagaaccaaagaccatacaggcacagccnnnngaaccctaattgaatataaaagctgcctagaagagggaataaattactttacacttatgctgacttcgatctctgcagtgaaagatctcaacagaagatacccttctcgtgatgaaggattcaggagtgagatccaaaggaaagagatatttttcaattcataaattcaggaaataaaaaggattaagcagaaaacagctgtcccccaaaaccccgaaagaatgcctgaaatccatagaaattcaataaaactcccatgtcggtaacataattttcaagatttcttaccgagagtatgcttgttgttatgcatccagaccttcaaaacacccttcccgacaccaatttcattacaaaactgctgaacaatagcctcatcctgcttctgcatcctccaccccatcttatctgcgaacatatacatcttctccttctgatcctgcgagaacttggtcctgaacctcttcttcatgcctctatgatgatggtggctgaggttattattactgttgttgttggtattgccatctgggtcatcagactcggtgagaccagagcttagcgccatgagcatatggggagccgaggaaccgtggggcaaggggagggggtaataggggacaacgggggaacccggccctgacgaggatgcgccgccacgcttcttgcggaggcagcactcgcaggtggggggcggttgctcgtcgccctcgacntcacggcggtggaagttgcggtngcatccgcaggcggcgcacttcaatgcgtcgtcttcagcgggcatgaactcccngcagnngtcgnnnnngnnnnnnnngat

SEQ ID NO: 17182 - DNA, 648 bp, Picea glauca
  Predicted polypeptide sequence is orthologous to G2990
ttttttttttttttttttggttatttgtgtttttttgcttgtggagaaggaaggagaagggtttgtggtcttcctcaatcactctgaaggcaacttaacaaccaccatcatcaccatcaaggatttgtaagtggagcaagggttcaatttcatttgccaaccggtgttgaatcttccattcataggtatgtatctagattctaaatccctccattcataggaggaggaggagtggcctgaagacatcatggagggtgatgtgaaaacatcatcacaaccttctacacttattgatacacctactcctgcacacaccaatggtcatccactatcagatacagggtcttctattgtcaggggcaagcctgacaaagaaccccttatcttttctcgtaaaagggggagaggcagaggtcgacattgatattagatagctagttgttgttttgtttcatttgtcattgtatatcatagatctacagactccatcatgagatacattttataattatatatgtgttgtcattttgtattggagaggcccttcaacattcaatatcgactttgatgtataattttttatttggcatccactagtgacagggcttgttgagaggcccttcaacattcaatatcgactttgtcagc

SEQ ID NO: 17183 - DNA, 802 bp, Picea glauca
  misc_feature (2)..(8): n is a, c, g, or t
  misc_feature (21)..(28): n is a, c, g, or t
  misc_feature (82)..(90): n is a, c, g, or t
  Predicted polypeptide sequence is orthologous to G2990
annnnnnncccgcgccatcgnnnnnnnnaaaagaaagtcggggctgccgaaaagacagagttttaccgggcgggggttttannnnnnnnncttttggattattccctcgagtaaaagacggctacttgatcggcgaattcaatggccgaacttcaccgagtttatgcggcctctcttcatatgcgccaaattccgaattttatggataaaattcggcgaatgcggtgacgctcccatcccccttgaatttcctgaaaaattgtggtgtctctcatgtgcgtttccctgctcccgcgtacggaaacttggtggaacattggaaattttctaggttgaaagatttcaacacagggaatgatggcagttgtacagggtaggtgattcttacaaattggggcaaggctttttatttcttacaccatttagtttgtagttgtgggaagttgcgcgtttgtttttcagcattttttttctgaatagaagtttttgcaagtgataggggcgtttcgctatgctagtcttgccacagagaaaattagtccttaacatgttgtcgatttattttcttgactacatacatactgagaatggaagtgccctcttgagctaaagggaatgctgcaagctttggtaaatttaataaaggaatcgggtgtttttgctcaatcatagcaaacatccgagtctgctgtgcattgatacgttattaatggcaactgccaatgcatgtatagactccgtaagaaactgataagtgaatcttttgattaaataaatatttaattaatgtcaaaagtttaca

SEQ ID NO: 17184 - DNA, 620 bp, Picea glauca
  Predicted polypeptide sequence is orthologous to G2997
ttttttttttttttttttcgtcaaagtgagatctgccattgattttcgagtaaagatggagatacaaattgtaggctggctggaattcagaagagcctgcagcctcatgagggcatccatcccaatacaagatatacaactaaatatgggatgatttgcagctgcccaggtctacttgaattacattacatattttaaatcatgggcgatcccattatgttacattaatctaattctagggatgagggtagactatgaaggaaggctgagcaaatccttctgtgcatgaaattggagggaaaagaaaaggtaaacatgtatttgcacttgagccgagtgctgatctacagcagtcacctcaattaatgaaaaggagaagcagaagagaaggaagaagaagaagaggagattattgggaggtgcattgttcttctgatctctgagccttggcagcaagcatatgggacttgttgttatgcatccagaccttaagaacgtgcctcttaacaccgacatccatgcaaaactggtgcaccgcggcatcgtcatgcttctggatcctccaccccactttctccgcaaaggcgagcattttctccttctgctcgttgctgaacttg

SEQ ID NO: 17185 - DNA, 699 bp, Picea glauca
  Predicted polypeptide sequence is orthologous to G3000
ttttttttttttttttttgaatatagatagcactgtcaattatgatggaaagatatatacaggatatatagttttttttagggacacaaccaacaattaaaattttccataggacagaaaaatagtaacccttaactatctagccgtttgattaatattataccagacatatagaaacagacaattaggttcacttcgccatagatcggaatggcggattatcacccgcgtatgcgatgagactcgcatagggtcccgtttccaacttccctcctatggaagctgcggtgacaattgcaagctgcacacttcatggcttcagccgttccctcatccccgctagctataaattctgcgcaaccatcgaccgcgtagcctccagtgctggcagcgtgattctttcggcactctctgtagcgcacaccctcccttgatgcagcatctccttctctaacgattgcggctgcgccctcttcgatctgctgcactatttcggacggccccatttcctctacagttgttatttattgaggatgaatctgtacggatcttgcttcagggaactctgatatcagatgtagaaatagagatctcgattcatctgcggcctggtaatttagctgtctatatctttgaaatcacatagaattgctgatggaaagagcgcagctgcaagtgctccgcatcctaatctgtatc

SEQ ID NO: 17186 - DNA, 894 bp, Picea glauca
  misc_feature (830)..(836): n is a, c, g, or t
  misc_feature (850)..(851): n is a, c, g, or t
  misc_feature (857)..(861): n is a, c, g, or t
  misc_feature (870)..(877): n is a, c, g, or t
  misc_feature (881)..(887): n is a, c, g, or t
  misc_feature (889)..(891): n is a, c, g, or t
  Predicted polypeptide sequence is orthologous to G3075
ggcagctaacaccccaaaatccgacaccccaaaatccgattcttctgcacagtcttcttcagatttcagcgaagagcaggaaaacgcagatgagaaaacgacacccacgacacccacgaaaagacccaccgataatggcgcttattcttctctaaatatagaggaggctgaaaccccaagccgtcctataagaatttcacaccacaagtctccaaggccggaaacgccgacaactgtggcgttccccacggccagagtgaggcgtgtaatcaggagcgagggcgatattcggacaagtgtggaagcgacctttctcattaacaaagccgcggagaggtttttggaacagtttgttgtggactcattcgaacatgttttggaggagaccaaaaatattttaagctacaagcctttttcttcaactgtggctaaccagaaaaggtacgagtttcttgcagactttgtgccggagaaagttaaagcagcagatgctctagctcaaagggcttcagcggaaatttgagcaatgtttgcgagatttcataatttttttgaagcatctatcacttattttgataatgcatttctttgaggatggagaagaacactgtatttcaaaggtaatttttaaattattgcaaatgcagcacaagaaattagcctagcaaggccaaggtcagtttcttttgattatatgtagtatcgggaaactaagtatactgtctaattattgtggagacaaacttgtattacacttatctgcttcaaagcatatggtagctacatgttctagtacttgtacagatactgatacttttttgtcaaatctnnnnnnngcttttcaagaagnngttttnnnnnacttgaccnnnnnnnntgannnnnnntnnnata

SEQ ID NO: 17187 - DNA, 792 bp, Picea glauca
  misc_feature (743)..(744): n is a, c, g, or t
  misc_feature (748)..(752): n is a, c, g, or t
  misc_feature (755)..(755): n is a, c, g, or t
  misc_feature (759)..(765): n is a, c, g, or t
  misc_feature (769)..(773): n is a, c, g, or t
  misc_feature (775)..(775): n is a, c, g, or t
  misc_feature (777)..(782): n is a, c, g, or t
  misc_feature (787)..(789): n is a, c, g, or t
  Predicted polypeptide sequence is orthologous to G3094
ctgcatcgaaggcttcaagtcggacgccgcggtcgtgctggaaggtgggcagatgacccccagctccgttctggagtgtggagattcctttggcacctcgtttggaccgcccagcgctggtaacggatgcagaaacacggcatgcaccgccacaaccgactttgaaaacaacagggcgccgagcggatatattgcctataatacgaaccgtcgtccttgtgcagtagaaactgctgctgcttcgaatcagagtaccgtcatgtccatgagcagacgcaaaggcactccccatagatctcctctcttttaaagttttcaactttcaagcaattggtactaagaattttcaatatttctgagctgttatttttaagttaggttgacatctgcttatgctgattaagggtttaaaatcaatcctccttacctacagtaccaccaccgccccttctggattcctctgtcacatattttgcactgttcagcaagccctttgatcagggaaaactcttcagagacgcttgcaattttgtgtgcatgcagggtgcatttgtaaggtcaaccggcgtgcattagggttagtaggcggtgacctttggatgcacccaaattttgtatatacgccattaacaccacccaagctacagtctgtacttgggaatgccatgcgaatatctatttacaacgtattttataaaatctcatcttcttaataaaaaaaaaaaaaaaaaaaaaaaaaaaannctcnnnnnggngccnnnnnnncaannnnncntnnnnnnagtcnnntta

SEQ ID NO: 17188 - DNA, 702 bp, Picea glauca
  misc_feature (596)..(596): n is a, c, g, or t
  misc_feature (632)..(632): n is a, c, g, or t
  misc_feature (637)..(638): n is a, c, g, or t
  misc_feature (640)..(644): n is a, c, g, or t
  misc_feature (658)..(660): n is a, c, g, or t
  misc_feature (665)..(667): n is a, c, g, or t
  misc_feature (670)..(671): n is a, c, g, or t
  misc_feature (674)..(675): n is a, c, g, or t
  misc_feature (683)..(691): n is a, c, g, or t
  Predicted polypeptide sequence is orthologous to G3094
ttaatgatatgatgctctccactgtccagcatataactttaataccaaccgaatgcagacaaaattgtgagggttcgccgacaaccataaggttaaagagagccgaaagcaagcctggcggaatcgatcgtggatcgacgatctcaacagagatccacaaccaccgcattacacaaaaaaggacccaagcttgaataattccttatcaatacagaggtgatctgtgagggaatccctttctcctgctgatggagggtgggatcacagattttggtgaacaagacaccatcattccgccaccacacctgttgctgttgctgctgcgcattttcttgggcaatgggtaaatgacgggcgctgcagtgccactgcctgagagccagcattcgtctctgtcactggcagaggacgttgaagacagtgactcttctggatacatttcttctcctccttccatctctagtttttcttccttggggctttggcttccaggagatgacgatggcgacaaaaactccctcagttgcaatgaattgcaagattgcagcacactcgacagatttttcaccgcgtctaccttgcatctgacggagcantaacggtagggttcctgcagcaccctgtcacaggtntcacnngnnnnncccaggcccttcgnnngtcgnnnctnnggnntctggttnnnnnnnnnactctcgcact

SEQ ID NO: 17189 - DNA, 401 bp, Picea glauca
  Predicted polypeptide sequence is orthologous to G3095
ttttttttttttttttttataataagctttgggcgcctacatggacattaaaagtacagtgtaggtactacataataccttgaaaatggactcacatcgcagccatacccacccagaaaatccgctagtgcacacaagacatacctcttcataatataaatgatctattcgaaataagttattaaaaacaaactaacttagttaatatattggcgatctgtgcggtataccctttctcctgctagatgatgtacgggcataaaagtggggtgccgcatgacgcttgcatattttctttatctaaggaatgggtatttccgaacatgtcaacatccatggcacatcgatcacattggagcctgaacatgtctgatccaacgtactgctatgcgatgattctt

SEQ ID NO: 17190 - DNA, 539 bp, Picea glauca
  Predicted polypeptide sequence is orthologous to G3967
ttttttttttttttttttttgaaattaagagacgttcattagaaagattgtacaagcttgcctttcagccatgccactgcaacgtaacagttctgcgagagtactacatttcttacagcatataaaaaaatatttatttcatcctcgaaactctagaaatacattagctatttcctgagaaacccaggaatgccaagttccatgcgccggggtgatatacactatgacgagaaaaatatgcggtgtcaaacatttgcagagaaacctaatgcattggctgctaatgcaagaagggcaatagacatcccccttgcttgccgattgtgggcttcccaagccaggcattgttctacagctttattccaatcttgaacaacgatatcctttccataatacaaatgttcagaatggtggtttttttctgaaaagttcttgcaatacctgaaattgagacattccgcatgcaagatatcccgcagaactgatgtactaagtgcgcggacatgagcactggaatgtgaaagacattgaacagtagc

SEQ ID NO: 17191 - DNA, 812 bp, Picea sitchensis
  Predicted polypeptide sequence is orthologous to G28, G22, G1006
ttttttttttttttttgaaaccaaatctgattgttaacataacattcttaaaagatatacaatgttttacagcgctctaccaacataaataagtatacaaacttttggtacatttagaaagaatagatacaaattctaggcttgtacagaaagaataatagaattttttgtcctttgaggaatggatagaaaaaacgcagggaagtcctcaattcaccatgagttgtccagcggagaggaaaccagtgaagctcatgtcgatgccacttggtgtgagtggcggcgttgccagcttcccacccaaaagctcttcaaccatttcgtgatccatcgtgttgctatcttcgaatctcactcgacattgtctattccactggacttcaacttcctcacgttgcctcttcttactcaaattactctccaccttttctatggtggacgtattattattacatgtattactgtcctccgcgccaacttggagggggaaattaagcagagccctagagcccctcatcttgtaagcggcacggtcataagcgagcgcagcttcctcggcggtagtgaaggtaccaagccaaactctagctccctgccgcgaagagtcccttatctccgccgcaaatttcccccagggtcgctgcctcacgcccctgtaatgcctccccgcattgttcttcacagtcggcggcggcggcggcggcggcgtggctcccgtttcttgacggatatccgcatctggtttgacgggcaaagccgcttccttcttgatctccgtcaccggctcttctttgggcgttcggggcagccat

SEQ ID NO: 17192 - DNA, 877 bp, Picea sitchensis
  Predicted polypeptide sequence is orthologous to G28, G22, G1006
gacagacctaaatttgtgcgtggatttattaggtcccttggaattcttcttaatttctcaggtttccacattgcagaaatgaacgtcctcgatcagattcggcaacatctgctcggggaatccgacggctcaccttcgttctgcaccggatcgccggcggagtcgtgcttgacggaaaattacgcgtcttctaacagctggaacgcctcggatgaactcgactccggcttcgtccaaagcgcgctggtaagcgatttcgttgaagaagaacagacggcgacggagaatcagccatgcggcggcaccaggttttctcgtcctgtgctctccgtcaccgttccgcggagggaatccttcgagtgggagagacgttccgttagctggggtgtggattcaaggaatttcgtcacggcttgttgcccggcgtccatcagacggtgcctttcctgtgagtgggggaagcttccgttggatgaaaacgattcggaggacatggttctgttaggggttctgaaggaagcgacgcagaagggctggacgccgttaactccgaaggaaatcaagaacgctgacgtcaagaaacagataaacccccggcaggaaactggacataagctgtcggagaaggagaagaagagcggggagagacatttcaggggtgtgaggcggcggccgtgggggaaatttgcggcggagataagggactctgcgcggcagggatctagagtctggctcggcaccttcgacaccgcggaggatgccgcttttgcatatgaccgcgccgcttacaagatgagaggcacaaaggccttgcttaatttcccccttgatgtggtttccaagtccatggataccctcaaagaggatgaaagttgct

SEQ ID NO: 17193 - DNA, 794 bp, Picea sitchensis
  Predicted polypeptide sequence is orthologous to G28, G22, G1006
gaggaaacggaaatcaatcgatgataacgtgattgtaattgtgactgagcagagacaacgatggacgttgcaggaggggtgagcaacaacataaacatgaaaatgttgaatatgttggagttgatccgccaccatttgctggatgtggaggacgaaatagatattatagatcttcaacgaggaaatcaagtcctcgccagcggcagcagattaacatcagatggcaataaattcgcagaagcacaagattactcctcgtcttcttctgtatgcccagttataaggagagaagatgcgtttaacgtaaagccacaggcacacgacgaggacaatggagagaacaagcagataagcagggccagccactacagaggagtcagacggcggccgtggggtaaattcgcagcggaaattagggaccctgccaagaaaggggccagagtttggctgggcactttcaacaccgccgaagaggccgctcacgcatatgaccgcgctgccttcagaatccgcggagccagggctctcgttaacttccctctcgcctttgcttccaattcagagaatggatcagccgtaagtcacatggggcagaagaggaagagaggaaatggtggcggcgggacactggatttgggggcgtgtggttggataatggaaaaattaatatgcctttcgtgataattacagtattattatgattacgtgaatgtatttacgaatatgattatttaaatattctgattatgagaatgtcagtttgagattgctataattgaaaaaaaaaaaaaaaa

SEQ ID NO: 17194 - DNA, 360 bp, Picea sitchensis
  Predicted polypeptide sequence is orthologous to G28, G1006
aaaattgaaacatttattttatttgccctttgtaacagggaaaattataatccaaacattttctgattctcctatcttcaatcttacacagtacacaagggaaattaagggtggagatgatgcagggggcttcagctagaattgctggatttttaccagttatcgaaaatttatcgtattgctacctatctcagccatacattatttatccagctcctctgtccgactccttcaatccaacgaccatccagccgccccactgacactgtttgctctcttcctcttgcgacctacgcccgatccgttctctgaattggaagcgagggcgagggggaagttaagtagagccctagctccgcc

SEQ ID NO: 17195 - DNA, 830 bp, Picea sitchensis
  Predicted polypeptide sequence is orthologous to G28, G22, G1006
ttttttttttttttttttaataatatttatggtgaaataacactcattaaaattataatcttgatctttttcattacaatcctgcaaagaacgaaaggggattaagggtataatcttagtttttattcattacaatcctcaaagtatgcttttcacaaagattgttggaatattaccaattcaatctctactataaattttcataatcataatcataggataggaacattaaatttatcgacgctcatccattgcccgatcttcagcttccgcttccactcccactcccgcagcccttccgactgcatgccgccctctcctccgccgtttcttctttacctctcttcctcttgtgcgccatgtgacctacggccgatccattttctgaattggaatccagagcgagggggaagttaactagagccttggctccgcggattctgaaagcagcgcggtcgtatgcgagagcagcctcttcggcggtgatgaaagtgccgagccaaaccctggcccccttcttggtggggtccctgatttcggctgcgaatttaacccacggccgctgcctgactcctctgtagtgcctggccctgctcatctgcttcatctttacactctcctcctcatgtgcctgtggctttacctttacatttaccgcctcttctcttcttataactgcggattcagaagaagtagaagatgaagagcgttgtgtaaagtcattctcattgtcggtggcgtggatatagtcccagctgctgccgctggcgacgactgctggggagaaggatactgaggatgggtgattttctcctacaggatccagatct

SEQ ID NO: 17196 - DNA, 892 bp, Picea sitchensis
  Predicted polypeptide sequence is orthologous to G4
ttttttttttttttttttttatctacgtacacaagtgataacaccatgaagaaggattttttcagatacgctacaaattgtctccaaaccaattacacagaaggactaccattggactgaaaccttctgcaggggacagtctggcccccatcaagctagtagattagtcattagaggataaaatagcatcttaatcaaaatctccagagattcttcacaattttctctgcaactaaataatccacaggtcccagtacccaaatgtttcaaaaacaattttactacatacgaatcctactatcctgtcttcagccccttgaagaggcttaactaatagaaaaacaaattataaaacataaacagaaagtgcaaaatatgagtccaaaagacctatacataggcctgcaacatcaaaattcaaatcacgagtctgcttgcttgttatgtatttataagaagcaagaactaagactgttttgaaaaactaaacctgaaatgggcagatcgtcatagagccatgattccatggaaccctgcacatctggaaaagagcccacagcatgacccgcatcttctattgattgattcacagttgcattaagattcggatcctctgtcaacccaagatatgactcaaaatcagaaaactcaagttcaacgttgttatcctctgttttgtagaatccacctgtcccaccatcgacctcaataggggtatccacagttccgtctttaacaacatcatctacctggggtttaatgtccacaaaggtagactcatttgcatcatcacatacagacgaaatttctggggttttcgtatcataagcccatgggaaatgcgccccttcaaatgacatgctgctatgatcagaatcaaaataacctactg

SEQ ID NO: 17197 - DNA, 817 bp, Picea sitchensis
  Predicted polypeptide sequence is orthologous to G4
ttgagtggtggtcgaagagccgatagtttcattttgagtagtggttttcagtcgatattttccagaaaagtggcggtttcgaatcctgcggaagcagcaccagctggtttgagagcagcagcagctggtttgaaagcaaaacgatgtgtggaggtgccatcatctcggattttattcccgccaatcgttctcgtcgtttaactgcaagggatatatggccggatttcgacacgttcgctgagtacatcaatggtggagccgtgccggaatccttcagtaaatccggcagcttcgacaagggttctcccgactccaacgagggatacaagcagaagaataagcccagcaagggtttcgtcgagtccaagcaggagttttcttcaggtgggggaaatgaagcgattcctcctttgaaggattttgaagggcccgtagccaagagcgcggggaggaagaggaagaatgtctacagaggtatcaggcagcgtccatgggggaaatgggctgcggagatccgagatccgcgaaagggcgttagggtctggctaggaaccttcaacacggcggaggaggccgccagggcctatgatgcagaggcgaaaaggatccgaggcaagaaagcgaagcttaactttgctgatgattcttgttttgcaaatttgggcagcaacaagaaagtgccagggaagataaacaggaaagtaaaatcctcttcgaaggatgtctgcagatcagatgtgccaatctacggctacgatgatatggaaaatggggacttggagttctcaaaacccggtgccccttttcaaagcaattc

SEQ ID NO: 17198 - DNA, 977 bp, Picea sitchensis
  Predicted polypeptide sequence is orthologous to G5, G974
ttttttttttttttttttaggttaaattcctgtatgcatcatgatacaaagattgatatataaataaattacaaatgaagatgtcatttgttcatctatctgaaccacagttcatgatactaaaaattgcaatactgaatgctaactttacactattacaaacaactattaatatcatcccagttcatgtccatgtccagagaaggaatactgagcaaataatcgtcaagctctgcccatatcgacgaggccgagaaggatggcatgctacacaaagtatccgtttctgtatctgcctgtgtctccgacttggaggccgaaggagattcggattcaccagctgaattcaatgctgtaatggtggaatcatcactactatcagactcacaagtctcagacttgacagacacaacatcattcttcttcgcatcctcatcctgcaccgacccaagagagcctgaattctcatatgcacatgaaatttcttctgattcttcagtcttagacattttttccatgggtagtttcaagctctggcaaattgcttgcagcttggcatcaacagccgatggcaacacagaattcccagtccagggggcgaaggaattcgcttccagatggcgtttgaggtgaggaaagttgagcctggcatactcaccccttagcctgtaagcagccttgtcataagccatggccgcttcctctgcggtatcaaaggtgccaagccatagcctcgttctgtctctgggtaacctgatctctgcaacccatttaccccagtggcgctgcctcacgcctctgtaaagcttagccgcctttgacaggccgctgctatgcagtttcatgggctgagctctgggacccagagggttccgacccatttggtggattgaagccgctgctgattgatgttgttgcaattgaagttgctgctgtagttgctgaatctgctgtgcatgtaacaagtcgtacaaaac

SEQ ID NO: 17199 - DNA, 408 bp, Picea sitchensis
  Predicted polypeptide sequence is orthologous to G43, G46, G1419
ttttttttttttttttttggaaaaacggaggaaagacctcaattcaccgttaattgtccacgggataagaaaccagtgaagctcatgtcgatgccactgggtgtgagtggcggcgttgccagcttcccacctaaaagctcttcaaccatttcgtgatccatcgtgttgctatcttcgaatttcactcgacattgtctatcccactggacttcaacttcctcacgttgcctcttcttactcaaattactctccaccttttctatggtggacgtattattattacatgtattactgtcctccgcgccagcttggagggggaaattaagcacagccctagagccccttatcttgtaagcggcacggtcataagcgagcgcagcttcctcggcggtagtgaaggtaccaagc

SEQ ID NO: 17200 - DNA, 738 bp, Picea sitchensis
  Predicted polypeptide sequence is orthologous to G129, G136, G140, G146
ttttttttttttttttttattgcaaattattttttcataacatattgccttctgaatatataaacataggatagatcgtcttactccttaattatacaaataataaagttggtagaacccatgttttgaagttataatgtgccacacacggaacacatttacaatgcaatatatattacatctcaacgttagaactaagtgagtgagtacttagatcaaatccacaaggaacatgttggttaggtaataaagttgtaaatccatgtgttagaagtgaggtaattcccttgccatttgtacattcgtccaactttccttgaagcatcatgttgctcatccttaacgtatgttccttattttgaagggttttaatctcctcaagcatgagttcattcttttttgatcgtacttgatttattcctttttgtaaacagcattctaattgatttagctcctcaaatgtcacagaaccaagcccttctcccatcaaatatctgttagtaagttttagctgatcaatttgttgtttaagtaaatttatctcttgcttctttttctcgtccgaagtaccatttgaaaagttgatatgttttgcggtctgtgagcacttttgatatctttcgagtatcggccttatgcttctgttgctgttgttgttgctggtgccgagctcgtacagctttcctcggctggagaaaacaatgagagctacctctgcatcgcacagcactgaaagct

SEQ ID NO: 17201 - DNA, 828 bp, Picea sitchensis
  Predicted polypeptide sequence is orthologous to G131, G135, G155
gtgaaaaatacccaaaatgggaaagaagaaggtggagctgaaacgcattcaaaaccctatcagtcgccatgctactttctacaaacgcaagggcggtttgcttaaaaaagcattcgagctttctgttctctgtgatgctgaagttgctcttatcatcttctctgaaaccggcaagatttacgagtttgcaagccacaacgatccaaccacaatattggcaaaatacggaagacaaatggaaacaaccagaaacgcaaggccatcatctcttcaaaacacagagtttgatcaattacaactcaagaggttgcatgagaaggcagagatattggaaaaaaggaaaaaaaatattgttggtgaagacttggagtcattaaccatgaaagaattggaccaacttgaaaagcagttgcgaaaaagcacaagaaggatttgtgatagaaagatgaaaatattttcgcaaagttctaagttattagaacaacaggtacgctctttggaagaggagaatactgaacttcatacaaagttcaatactacaggcgattcctccacttcagcaccagatttgtttatccgtgcatcggtaccaaaaactcaattgcatcttgggcgctgtgacgagaacagagatgaccactccttcgccagcgagctacagtaatccaatacaattactccgttgtattagtaactgaaatctctctagtgctttgagacgatttaatatatatgtgtgggggcagacagtacttttaattttctaaaacttaaaacatcatatcacctcatctggagtgaaaattcatggacttattacagctcttg

SEQ ID NO: 17202 - DNA, 719 bp, Picea sitchensis
  Predicted polypeptide sequence is orthologous to G137, G145
ttttttttttttttttttatcaaactcattctataaacatattttatgcgcttgttcacatctgtttatagcagcgttttgtaattgtccgagtgatatacctattacaaattcactaaagtcgggcgattcaattgacgagttaccaccctccatattagcggactggaaaataatacacctaacatgtactgaatgaaagtttcaaaccctccaaccctgcgcttcgtaatttcgcgattgcctttggccggtggtagtgcttccactaggggccgacggacgccctatatggagagtcgggttgcagtgcggtgagtagacttgagtgtcatagtttcctgcagtagagtgccacgacccgcggaatatttgtataggatactgatcacatggatattgtccttccaatcccgaaaacttcttatgaagcgacttgtttattccctccagcagctgttcctttctttgtagttcttgaatcatgtccaacataaactgattctttttcgatgtgatctgttttaagccttcttcgagttgttgctcaagttgttgcaactccttaacacttagtgattcaaggtcttcacccaaaaaatgccttctccgtctttctaagctttcaaccttttccttcaattgcgtcaactccaagtttgaagtctgtgtatctttgttgttatcttgtactgaatttgaacacttacgatgccttt

SEQ ID NO: 17203 - DNA, 770 bp, Picea sitchensis
  Predicted polypeptide sequence is orthologous to G154, G627, G1011, G1797, G1798
ttttttttttttttttgaaataaaaatataatatttattttcaaatattaaaaattttcaatatcaaatttcaaccttgatccaagttgtgttgatacttggtttcaaaaatacttagaaagacactgcagttgtaatgtctgtataatgaaaaaatgagaagcttgcagtcgtactgtctgtatagtgaaaatatgagaagcttacatatgcattagtaacaattttattatatgagctatcgataggaaggggatcttatacatttggaggtctcataaccagttgagtctccacttcaatgcgctggatgtttccaagctggagtacaggtgatgtcaaaaccggaccatccacatattcagcacacttccttttaagctgttctatttcatccaccaatactttagtctttcgtgctcgtatgtggttcaaccctcgttcagcttggctttctagctgatttaattctttcactgaacatgatgttagatcttcccccatcatctttctttgtgttgattcgaggatcctaattctctcttccatatttgcaatttctcgttttaaatgctgattatcttgctctttggtagtgttatctatgtcactttcttgtgcatacttttgatacctctccaacattttttgcatactgggactggcgaattcatagagcttccctcgtggggcgaaaacaataagtgccacttcagcatcgcagagcaccgacagctcgtaagctttcttcagcagaccgttcctgcgct

SEQ ID NO: 17204 - DNA, 772 bp, Picea sitchensis
  Predicted polypeptide sequence is orthologous to G154, G627, G1011, G1797, G1798
ttttttttttttttttggatttcaaaataacatcaacaaacatagttaagtatcacaatgacgactatttacatgaaggtgatcttgtgcaaactggaatttcaaaataacatcaacaaacatagttaagtatcacaatgacgactatttacatgaaggtgatcttgtgcaaactggaggtcttatatccaattgagtctcgacttcgacttcaaagtattgtacacttccaaatccaattgcattcattgctaaaacctgtttacgaaggaatgtgttctcctcaagtaagagacattcctttcttttaagttcttctacttgacccaataatatttcagtctttcgtgctcggatatgtctcaatccccgttcaatttggacctccaattgatttaattccttcattgaacatgtgcgcagatcctcccctgacatctttctttgtgttaattcaagaatcctaattttttcttccatatttgtaattttccggtttaaacccttgttatcttgctcattggttgtattatgtgtactatggtgcctctccaccattttctgcatgctgggactcgcgaattcatggagcttcccactcgaggagaaaatcataagtccaacttccgcatcgcagagcaccgagagctcgtaagctttcttcagcaacccattcctgcgcttagaaaacgtaacctgcctcctgctggcattctcgatcctcttcatctgtgtctttcccctcaccattcttggctctcctctgtgtttt

SEQ ID NO: 17205 - DNA, 847 bp, Picea sitchensis
  Predicted polypeptide sequence is orthologous to G154, G627, G1011, G1797, G1798
ttttttttttttttttggatatgatataataatatagaaaagttcataataaactaagaacatgcttgaatttcaaaataatatcaattaacttagttaagtactcaatcagaattattcatgaaaatgtaatcttgtataaattggaaatgttatacccaattaactttaacttagttatgtactcaatcataattattcatgaaaatgtaatcttgtataaattggaaatgttatacccaattcagtgtctacttcaattttctggacacttccaaatccaatttcagccattgttaaaacctttctctcaagctggtctacttcagccattaatatttcagtctttcgtgctcgtatatggctcaatccctgttcaaactggatgtctaactgatctaattcctccatcgaacatgtttctagatcctcccccaacatctttctgtgagttgatttgagaatcctaattctagcttccatatttgcaatttcacggtttaagtactccgtatcttgctccttatttatactattttcacgtgaaccctctcggtacttctccagcattttctccatgctgggattggcgaattcatggagctttcctcctggggagaaaatcatgaggccaacttctgcatcgcagagcaccgagagctcgtaagctttcttgagcaatccattattgcgcttagaaaatgtaacctgcctgcgggcggcgttctcgatcctcgtcatctggatctttcccctcgccattcgtatctctcctcttatttttccctccaagcaatcactaacagactctcaggtcgggcataacagaactgctcggggggggggg

SEQ ID NO: 17206 - DNA, 777 bp, Picea sitchensis
  Predicted polypeptide sequence is orthologous to G194
ttttttttttttttttcgtaaaatagtctcgagttttcactcgcacgctatcaggttattgaaaaaaaggttggtcggtcctaccattagagtgttcatgtctacaacgccactcattagggttttacacaaaccttccagtctttcaaaacatttcaaatcgcattacttacgaaacaacttcaaactttatcatgacctgatttaaaactaagccaaggatgaattgccataggaaataccagatcggttaggttaggtcaatctcttggccaaacctaattaaaaagcactgttaatctgtgacatcagaacatgccacaaagtaacggactctaccatctggctgcttccactagaagaatctcaaatgcaaggcagctccgagtttgggcaaattgcaacccattcaaaaacaaaccatcatgggttacctgttttactgataatggcctctgaaccataaaattgcaaagactttttaaaatctatttcattttatgatcttcgcactctgattgagacctatatctttaaagtccatatgacacggagaaccaagcacctgagaatctgaccactaacttgtaattttcgtacttcattggatcacaacaactcgttgttgtgatccaccagataagatgctcccactttttgcactgctgccttcctcacctccacttgaaagtgggtgaaaagctgatatatggaaatgttgatgttgatagtggttaagatatgttccattagtatgagcatattggtaagttgtac

SEQ ID NO: 17207 - DNA, 815 bp, Picea sitchensis
  Predicted polypeptide sequence is orthologous to G197, G255, G664
ttttttttttttttttgagctaaggatagtttatttttaatgacagtttatcaagaatcttgagtctgatgataaacgaaaattcttctacaaacaaagttaaaaaggcgacaaattcgcaactgaattttgatatttcttacaaccatgaataaattattaagagatctggatggattttccttgaattagggcacgagtcctggttcttccatcgcgttattgcgaatctccagtctcatctcagaagtagccttgtcccaagagggcattcttcgtaacgacacagatatcctttttcatcaatgagatcgccttcgcccggtttggattttaaaatgggttcttccttcgcagctgcgtggattgaaggccaagttattgacagctccaggttcagatttaggttcgagggttcatcccgcgctagtgatccgctcgccgcatctgaaacttgctcggagtcgccgcataatcccgacggactatgaaagaaatcttcagcaatctcacgcgaacttgctatttcaggctcgctgacattccctggaagagaaagatcacggcgagaattcctttggaatggacgatgggtcaggggatcgactcccatactgataagctttctcttcagatgagagttccagtagttcttgatctcattgtccgttcgaccaggcaatcgaccggctatcagagaccacttatttccaaggagtgcgtgcagtttgagaataagatcgtcttcgtcctcagaaaaactcccacgtttcagatcagggcgaagataatttatccatctcagcctgcaactc

SEQ ID NO: 17208 - DNA, 833 bp, Picea sitchensis
  Predicted polypeptide sequence is orthologous to G197, G255, G664
ttttttttttttttttagaatttagacatcttatgtttcatatgtaatagtgtaaataaagttcaacgataatacacattaggttagaaaagagaccagctctgatctggaagacggttttcgaagatttagtattttccccgtagggttttatcgatggataagggtcaaaacggtcatttcatctgttatcaaccgtctgttggagacagtggcggagggcactctccatgacgacataaatatccctttccctcactgagactgctttcgccttgctcggaattaacaacggcctccttcccagctgcgtggattgatgggcgagttattgacagctccaggttcaggttgaggttgaagcggggaagctctttccgggctagtccgcttgccgcatctgaaacttgctcggatttggtgcttaattccggcggacaatgaaagaaatctgggacaatttcacgggactgtgctgttccaggctctccaacatttcctgaagccgaaggacgatgacgagaattcttttgaaatggacgatggttcaggggatcgacccccatgctgataagttttctcttcagatacgagttccagtagttctttatctcgttatccgttcgtcctggcaaacggccagctatcagagaccacctatttccaaggagtgcgtgcagtttgagaataagatcgtcctcatcttcagaaaaattcccacgtttcagattaggccgaagataatttatccatctaagcctgcaactttttccacaccgaagcagacctgaggcgttggggagagagcgccagcagccctctccatgagcctg

SEQ ID NO: 17209 - DNA, 813 bp, Picea sitchensis
  Predicted polypeptide sequence is orthologous to G197, G255, G664
ttttttttttttttttgacgtcgcgattttccaaaataacattgtactcaaccgcaaaattgtattaaacctcggtaacaatccatttttacaatcagtcctatgtggcctcgaattaccaccctactaaaagaaatccttaacaagtggattttatttaaccctcacgattccaaatggataactaatattttattttgtacgattccaaatggataactaatattttattttgtacatgcacaataaaaatgggtttgtagcgcttaatgcaacgtctccaaagataattggaccatgcacagaggagggatcaaagaattttttaatggcttccttctggacaaactttcagcgggcgaaatcaaactccttgtcgacgctgatgctggaacttgaactgtacgcttcttcgggcaatttgatatttgaactggagtcctttcggcaaatttggcctctcagtttaactgtgatttgggacgagagattcactgcaagtgtcaaatgcacaaatcaagattgaggtcgggacgctcttcggcgtcggaggcggcccgcttgaaggctgagctctcctggcggtcataatgaaaaaaatctgctacctccgccgttctgggactctgaaacccccgaatttcatgctcagggatgggccgagagctaagagtagtcttgcagggctggccgaggggacgatgggactgggggtcgagtcccctgctcagcaattttttcttcatgtgcgtgttccagtaattctttatctcgttgtccgttcgccctggtaatctccctgcaataagcgac

SEQ ID NO: 17210 - DNA, 541 bp, Picea sitchensis
  Predicted polypeptide sequence is orthologous to G197, G255, G664
ttttttttttttttttttcgaaaaaaaatagaactttgtcttataaaatattaaactcaccataaaacttggaagcctccttattgactcagccactcttatgagaaatggctagcagcatccaccacagtttactcgtagccctatgtcacaacacactccgccaactgaattagaatttgaatccatgattctatccagtgcaccggtaactctgtttaatgcgatggccgaattagatgacaagctgatacacaaatcgagattgaggtcgggatgctcttcgccgttggaagaggccggcacgaccggagagctttccgagcagtcttgttggaagaagtctgctatctccggcgttccagggctctggattgccggagtttggtgctccggggcggctcgagagctgttgtgtggcgagcagagggggcgatgggattggggatcgagtccccttctcagcaatttcttcttgatataggacttccagtagttctttatctcgttgtccgtccgccccggcaatctccttgcaatc

SEQ ID NO: 17211 - DNA, 776 bp, Picea sitchensis
  Predicted polypeptide sequence is orthologous to G207, G227, G242
ttttttttttttttttaccataaagaaaactttttattcatttttgtatacaagccgcagcagaagagaaagtattcagattcacaatatacaattcaaaagaaaatcgacagaaatcgagaacgctttcatcactttacagttctggcccttcgggagacacccattctcccaataaattccaatccaagtgcccctttatttcagacgctttgaaattatccctcgaggccgcaccatgtttctcgaatttctccatttcactgccacaagatccttttttatttcttcagcattaagccaacttctctaaacactggagctacagaattcaagccaggcccctgattcgaacactgcgatccgttggtataattctggacctccttcgcgatcatctcccgcataatagacagcagacttcccccaaaattagaataatcgcccgaacatcctccgtgggaattaccgctagacagctggaaaattagcggcagtgcttgcccgatcgcaattttgacggcagtagacatcatagccatggcttcctctgtcttcaagtagccactaacaggaaacggatccgcaaacgaataaccagtttgctgttgataagcttgaaactttgcagatttcgtctcgaagctttgttctatggggctacattctccactgctgttattctcactgaaagaaccgcttccaggcagcgacaggctcaaggaggtcgggggatcgaaagcgccagctgacccggaagcagaaacagaggcaga

SEQ ID NO: 17212 - DNA, 817 bp, Picea sitchensis
  Predicted polypeptide sequence is orthologous to G261
ttttttttttttttttagagcatcattacacacgccttgtccttggggattctgagaatgactgtgcataggcttgcgtctgtgaatatttttcaacaaattcctttgtccccgaagaaaatcttcatttgcgaattcccattgatctggatcaactttcctaaagccatatgtattgagctgtctgacaaagctggagaaattgttgtgcttgaagtacttgggcaacaagtctcgtgcgaattccggggggttccacacaatgaagctgttattcccggggctccatgaaactatcgagtccgtggagttgtcgtccaccatgtcatacgtcttggtgagaaacggaggcaccgcattgccaccgctgttctgagatccatccatatcctaaaaccccagaaatcgaaaaacccaaaagcgaaaaaacccaaatcaatacatggactcagcccgccgcggtacctcaaatttacatcattcggaacccaaacactctgatttctcagaaggtgctggcggagtccttagagcaacatccgccgatccctggtcggcatcgtttatggttgagactaggacggtatctgatcgtcttcgagcccccaactttcgttcttgattaatgaaaacatccttggcaaatgctttcgcagtggttcgtctttcataaatccaagaatttcacctctgacaatgaaatacgaatgcccccgacagtccctattaatcattactccggtcccgaaggccaacacaataggaccagactcctatcacgttattccatgctaatgtattcagagcataagcttgc

SEQ ID NO: 17213 - DNA, 802 bp, Picea sitchensis
  Predicted polypeptide sequence is orthologous to G274
ttttttttttttttttaagtaatcaggccttgcagcatattcacatgaatccatcctcttacattaaagcccaaaatcgcaacaaaaattcagaggcaggctccattgccaatttttttgcaaattcctttgtaagaacctaaactaacttccttgaccatccgtggatggggaccttgctggaatatcatacaatgttccgatcatacttttctcattacttttgctcaaaagtctgcagtccggttcccatcagccacccaatactttttcacagctatcaatactttttcaggaacaagaggtccatcttcatgatccaccagcttactatcccatctaataccacctaacacctttttcaccctgttcaacacgtcaacgttgtctcgaagtataactgcaccctctgggcgcaaaatacgatccatctctaaaagaatgtcttctatgttgcacctgtcttggtacatgttgaagactccgtttgcatgaattaggtcatatgtccttggatatgttgagaaagcttcacaccagtcatgataaattccaataaggcctctttcatatatcacaccaagtgtattgtcttttgcaatggttgggacaacattcataacccaagctttgttggatgtaagtgctgctgcgaagccaccaagacctgcattcatgtccataacattgcgatatctaatctctccaataaatttgttgattcttttgtaggccgtcacgtgcttcttccacaactgtgtatcagcattatatgactcagctgtaacacctgataatgaac

SEQ ID NO: 17214 - DNA, 775 bp, Picea sitchensis
  Predicted polypeptide sequence is orthologous to G275
tttatcatggatcacacacaatgcaccctaattccttgccttaaccccattgtaatcttcgaccccaatctaatccttggtcgagttaaattcaaggcggatctcaagtataacttgcacgaaggcgtgctcgaaagtgtatctccgcagagaagctctggacctatttatagtcacagtctactgtccactgttcatacaattttgctttcacaataccaagttctttgggttgtggtaaattgccaggagttagcttaatcagccccactttctgtttaaagaagttaccaaatttggttgagtgagagatgcaaggatagtatggatgtccccaccggagtgtcacaacaaatctgtcaacttatcctggcatgaaatgtaggacccttttgtttgggcaccctagtcccatatgttccatcttgttccttttcgaattctcctctgtacctcttctggtgggcagagcgcagagtaactgaaccacaaatgcaaaattctgaatggagtaaagattccgatctctttggcttcgctgtattggaatgaacaacgggtgtttacaacttcgatcaggagaagaaacagatactggactgaagctgcacatgagctaaaggagcatcaggaaaattggtccacgcccattgtcactgtatccgtttgatatggctcctgggaaatatggccgcaaggaaaaacgtccgtcttcttgtttttcatcagtggcagtggtggttttcgtggcattctgctttcttggggcatgggt

SEQ ID NO: 17215 - DNA, 860 bp, Picea sitchensis
  Predicted polypeptide sequence is orthologous to G275, G837
ttttttttttttttttttgtagagaataagccttataatttgtcacagttaaaattaaataaaactcatatcacaaatgagtgtgaccaaatccctgttaaagccccagagttgaaacaaatgatactaatccagaattatctgaaatactaaacaaacatgctccatccagaaattagctgaacgattaaacatgtatgttcctacataaattcccttcatttgaaggggatagggaggaatatatagacagctaataaaatctagtaaaggtgaacagattctggcaatacaattaaagaatcaaaaaacaacttggtcttctggaagaaattcaggctctaacatacagtggagcaggttccgcactgacttgaaccatttgtacacttgaatgttgctgccagataaattgaataaaagcattcaagctacttgctgtggccgccacatggtcttctgtgcacataggatcccttcctgatcttgagaatatgtcattcggatttgccactgtagtgactttatcatgttttccaattcattcagtgtctccaccctatcacggaagatgattgaaccccctggccttaaaatgcgatcaacctccgccattacaggaactaagctgcaccttttattcaacttagagaacaagtgatcagcatgcaaaagatcatatgttctggggtaagtattaaacgactcacaccagtcatgatatataccaaatagaccacgctcatagataattggaagcgtgtttggagcatcaattggcacaacattcataacccaaactgactgtgatgctagagctgctgcaaatcctccataaactgctttcatgtccataacat

SEQ ID NO: 17216 - DNA, 665 bp, Picea sitchensis
  Predicted polypeptide sequence is orthologous to G343
atactccccgctcgcaaagggcggtgcccgggcggcctcgcagcaagcggcccagaagctcaggagccccaattcgtggttggtctacttctgaagattacgcattgcggcatgagggtggcatgaagactgtaacagggactggcgctataaataattaccagtcctcggcgtcccagcagcagccaaggcgctgcactcactgtctcagccaacgaactccacagtggcgattgggcccgttgggtcccaagaccttatgcaatgcctgcggtgtgaggttcaagtctgggagactcttccccgaatacaggcctgccaagagccctactttcattcgatacattcattcaaattcccataaaaaggtcttggagatgagaaatcaggaggccgacgatctagaaagtctcgtgttcgatccccagctctcagatggcaaacaacaagaccagggactgttgaaggttaaaattaaactcaccggactagataacttgtcatttcagagcaactaatgctcgtgactgttgtgttacatagccaagacctagaggaaacgacaacaagaaatacgtatgtagcatattagaattgtttttacaactataacatctcttctataataaaatctcttctcttctatagtaaaaaaaaaaaaaaaa

SEQ ID NO: 17217 - DNA, 715 bp, Picea sitchensis
  Predicted polypeptide sequence is orthologous to G343
ttttttttttttttttttcttttttttttttttttttttttttttttttttttttttaaaaggaaaaataaaatccacctttccttcacattccctgaaataattttcaatccaacactagccaaacccaaataagtcaattctcaatctaagctaaatccatctaaccggcaaaagggtctaaagattgtacagttacaaggaaaaaactcacgcgctgaaactctacgtacacaggttagctaggaaatcatgaaaatgaattcgccgtcacataacaaaaaaattcaaggtcatttccccaaagcccccgtattgagggcactgtcgggcctgcaattttttcttcctcgtcgggttttctcgaatagaacaccacgtttttcccgtcatttcacgtcgggggattaaactcgaaggggctcttgggacggaagaaaattgccaaaaaacgactcgttgcctccgtttgaacatgtcggggacgttatatccgacctctgttcttcttctttctggcgtctcatttcgaggatttttctggggctattggagggaacctcggtcaaaaacggggggcttattgctggcctgtactctgggacgagtctgccggacttgaacctgacaccgcaagcattacagagcgtcttcggccccaagggtccggctctccactgaggagtcttctgtacaaggcaatggctgcaccttc

SEQ ID NO: 17218 - DNA, 774 bp, Picea sitchensis
  Predicted polypeptide sequence is orthologous to G390, G391, G438
taaaaccctcaaaacctttaaatgccaatttccactcaccaataataatggcgataccagtatgacgcaatggtgaggctgtatacctactcgcattcgccttatttatacacgcctgcagtttccgtttctcatctcagctgcccaatttctcattacctggaattttaaaaaatattgcggagggtgagggtttatcaggggtttagttctgccctttaagatgccgttagataacatttggacagtctcgagttcgagtcgccgaagacccgcgcaaaggctttggtttggccgcgagcaggttgttttgggccaatttctccagcggcgttcgttctcctttaagcaacgtattaaaaggcgtccgattttgtactctttggctcctagggcggctaaagcgtggcttgcgttcagaagaaggtcgaagaggaagatagacaaagaggcttctcgcattgagaggttaaatttacagctttttcaacggaatcagtgcatcgtagaagaaaatgaaagactgaggaaacaggctttactactaaccgaggagaatcaacttctacagcagaagctgcaagagcaacttaggtgtccagacaaagtcttgggagcctaaagagtagttactattgtttcttggaatcttggatttctgtgcactgtatatcatgagagcaacgtggataaatgatgtacagttgagaaatcaattttgttagagtatgatgttagatgggtacatgttgaaaatatttgctgggatattca

SEQ ID NO: 17219 - DNA, 679 bp, Picea sitchensis
  Predicted polypeptide sequence is orthologous to G390, G391, G438
ttttttttttttttttttcaaaaatgtagggtataaatatcaaatattgatggcatagaatcatgttggcaccctctacatcatcacttacaacaatttattcactagattgtttctatcactatgagaacctgctcatctttcattaatcatgacgctatatgagtaagtactcggaccaacagcagaatgaaaaaatttccattcttttacttgcccattttgcgtcaactctattggggtaggatgaagccctctaaagagaagctactgacttacagcagaagcagaagatagcattgacattgtaaaatattgcatttatatgcaggagttagcatcctacaattcaggttaaaaatgaccaattcacaaacatgacggtgacaacgcaaatgctgtcgttgctgtctaaaacattccaagccattgctctctcaaaagcaacaggtcttccattactagagatccggatacctgctggcatgtaggaatatccctgttgcaggacttgaagcaagtctttgtaagcagcctgtttctcgttttcgggaactgttttgagccatggaagtcctggcaaagatgctgcagttgtttccagcatgtctagacctgcctgatttgcaaaaacatattccgggatatgcttggaactacaacagattattgcatcctt

SEQ ID NO: 17220 - DNA, 507 bp, Picea sitchensis
  Predicted polypeptide sequence is orthologous to G390, G391, G438
ttttttttttttttttttcatgacaaaatgtctcgctgagaatctttaaatataacaaaatgcaacaacaaagtgctgcttacaaaatccatccaagttgtctataggtataagagttctgacagtattagccaaacaagctgaataaaatatgtgataatttagccgactacttaatttccacaaaaatgagtattcatctactcttctgcatgaacaaaatggtcacataaaggaccaattcataaacatgaaaacgatgcagtgggtactgtcttcgtcgttcagaaccttccaagctattgcccggtcatatgaagcaggcctgcccatacttgagagacatatcccagcaggtagataagcataaccctgttggataatttgaccataatctgtaaaaaaacttttgcgcccattttcgtcaagaattttgtccaaagatatatcttgcaatgcaaccaatgttgtttccagcatgtccaaccctgcttgatttgcaaatgc

SEQ ID NO: 17221 - DNA, 384 bp, Picea sitchensis
  Predicted polypeptide sequence is orthologous to G390, G391, G438
ttttttttttttttttttgtttaagaaataaattttactgataggtcttaataactaagcatctgtcctttaattaaagagaatgcatccacaagatgctgcttacatgatccattagagcctttaaaatcttttagtagggttgttctgtccagctggcataaaacttaaagttacagaagcttcaaaaagcagtaaacccatttgtttggatgataagatcccaacatggcttttctattgaatttacatcccaaaactggtcacacaaaagaccaattcacgaacatgaaagatatgcaatgagtaacgtcttcatcattaagtaccttccacgctatagctcgatcatatgaaacaggcctgcccatactagaaatgcac

SEQ ID NO: 17222 - DNA, 876 bp, Picea sitchensis
  Predicted polypeptide sequence is orthologous to G394
tttttttttttttttaggtaaaagaggagggccattgaaagaacatcatggctccctgtgtattatcgatttcgtcaactggtttttacaatgagagaacaaacccacagaaatataacaagggaaaaaggtctgtaaaaatacgaccagatccgtccacagaaatataacaagggaaaaaggtctgtaaaaatacgaccagatccgtccgtccgtatgagctataacaatttttctcctaacttccatccatgattcccacccataaccatatgcacatacttaacactaacacacacgcagctcgctctctctatctgtctgtattcttcgatcccgcgacgtcagagtgcggggattaatttactgtagtttacaatcaaggcagctcctcaataaataaacctcgaggggccctgagttgattacagaacaccgatatacaattaattaacaggccgccgaagaatgcgtataaggatagaactgcggtttcgccaaagtgaaaggcggcggcctgctgttctccgccggaacaaccctttcacaggaggggcacatggtcagagttgccgctggcatttgcatatacagcggagacgccaatttcagagctctcaattcctgcaattctttctgcaatcttctgttctcgtctgttagtgattcgcagcatcttttcaaaaactcgcagtccacttcagtttgcttcagctttgtccttgctcttctattctggaaccagacttcaacttgccgagggcggagattcagccgtttggccagggcttgcttttgcttaggattgagggagctgttctctttgaagctttcctccaaaagagccgattgctccttggacaatctgagtttctt

SEQ ID NO: 17223 - DNA, 860 bp, Picea sitchensis
  Predicted polypeptide sequence is orthologous to G409
ttttttttttttttttgtttgtagaacaataacatcaatatatagcagattggtaggaagaaaaaaggtaacaccgctgataaccaccgtaaataagctttgcttatctttatgtcacaaaggataatatatgttctcaagagaaaagctaggccagatgatggatggtaactataatggaatataagataatgcttgttacttgctagaggcctgaagaccaattataatcccacaagagcggaccagtctccaaattattgtaaaacaggtaattgcaaggttcatctgcttgactcacattttcctctactttaggcctgaaattgcattcaagccgagggtcacgagctttcacgttcgagaatcctatagaatcaatattttgttggctgtcaatggtacccgggctgtccatgtccaaaacagaactgccttcacttccaatgctggaaggcccttcattattattttccttgtctgcacaatcaactttggttgcagacatcatgagaagctgcaagtcctgatcgtctttctgtaatttggaagaattcgcctgaaatttctggtcattgcagctctgtgatttactgctcatacgttcgatcatggcctggagattgttattctcttccataaggttatcataatcttgcttcagagcatcatagtcctgcttgagaacattgaagtctttctctagttgcttagttttccatcttgctctcctattctgaaaccaaacagcaatttgtcttggctgcagacctagagccttggccaactgcattttcttctctggttcaagtttgtttgcaatttcgaaatttttctctagagccctcacttgctctaag

SEQ ID NO: 17224 - DNA, 764 bp, Picea sitchensis
  Predicted polypeptide sequence is orthologous to G409
ttttttttttttttttttgtagaacaataacatcaatatatagcagattggtaggaagaaaaaaggtaacaccgctgataaccaccgtaaataagctttgcttatctttatgtcacaaaggataatatatgttctcaagagaaaagctaggccagatgatggatggtaactataatggaatataagataatgcttgttacttgctagaggcctgaagaccaattataatcccacaagagcggaccagtctccaaattattgtaaaacaggtaattgcaaggttcatctgcttgactcacattttcctctactttaggcctgaaattgcattcaagccgagggtcacgagctttcacgttcgagaatcctatagaatcaatattttgttggctgtcaatggtacccgggctgtccatgtccaaaacagaactgccttcacttccaatgctggaaggcccttcattattattttccttgtctgcacaatcaactttggttgcagacatcatgagaagctgcaagtcctgatcgtctttctgtaatttggaagaattcgcctgaaatttctggtcattgcagctctgtgatttactgctcatacgttcgatcatggcctggagattgttattctcttccataaggttatcataatcttgcttcagagcatcatagtcctgcttgagaacattgaagtctttctctagttgcttagttttccatcttgctctcctattctgaaacaaacagcaatttgtcttggctgc

SEQ ID NO: 17225 - DNA, 815 bp, Picea sitchensis
  Predicted polypeptide sequence is orthologous to G418, G965
ttttttttttttttttgtgagtgatatccatttcagatgagtccttgctctcctgcaggtacatctcttccaccatcggcttccagagcctaactctggcatttatgaaccagttggaaacctgacttcttgaaaggccggtttgtctagccaacatatgcttatcggcatctgtagggtacgggtggagaaaatgctcaaataaccatgcacgaagaacagacaccgaacgttcaggaagtcctctctgtggacgccaagcatgttgttcaagcattcctaaatgctgcaccgctcgttgttgcctaatgttttgatcaataaatcttaatcttggtgtttcccctttacttacaccagcaagactggagtcctcgcctaatgccttgcttgtgactctaagctgattattgattgcgtctcttaaacatttaaagtgtcttgacattgccttcagtgccaaggcagtgtaaggagttgccgctcctagaccggctatagattcaaaagacgtaacaaccatcttcatttgttcacaatactgcccgtatctcctgtgcacctcttcaagcattgataaaagcttcgttctcctcctctgaatttcaaatctgtcaccagaatatgccagctgctccattccgctttcacttgtttctccagggacaaaggtagttgatgctgctgcacaggagtcacccatttttccaccgatatcacttttgatatctaaactattctgaacaacactgccacctcctgaacttctatccacccatccagcttgaggtttagaaagtttttgcttgggcata

SEQ ID NO: 17226 - DNA, 779 bp, Picea sitchensis
  Predicted polypeptide sequence is orthologous to G431
ttttttttttttttttcttcttgagaaattcttgcttgagactgctgaagtatccactgtacttacggaggagttgatctttcaattccctgtcttctgcacgcggatcaacttcgtgaacttcgatttccccacagctgaactcctcttccgaggatccacctccatcttctctttcgtcgcagtagcctgaagggaaacttctgatagctcctttactcaagcaatttagctgtgcctccattttgttcagaaacgttctcgcttctttgaatggcttacttagttctaaatggtacttgatcaacatctggcagtaggcctccatgaattgatcaagctccggatccactcctatatccatggttgccaaatggcgtccaagctggttctcctgactaatctcatccaatactgtgaccacttcaggaggagccccaatcttctggcaatccatgtaagctgccaacagctgaggatagtgaggatggcaagcgatttttgttttcagtgtatcaatggaatcgttagggttactggaacaagcgctatcgatatcgacctccaaggaagtcaccatcctgctggcttcttggtggtggtggtgctgctgctgctgctgaggagctctcaccaccaaggatggctgtgggcagcacgaccttcctcctccactcgtttttctgtgaaattccaactgattcgaacacacttctgtcttgacagaagacaaggacgagtcggaaatgacggccgcctgttcattcatcaccagctgt

SEQ ID NO: 17227 - DNA, 799 bp, Picea sitchensis
  Predicted polypeptide sequence is orthologous to G450, G456
ttttttttttttttttcccacaatctcatgcaatgttttgataaatgaaaacttacatcaacgcattcttcaaggaggaatccgtaatcttatatacattacaattgaaacaatgtttcgtttccatgacaagcaggtcttgagctagctacagaaatgaatatacccaactgtcatcatgacaaatagcaaaatacacttttacagttcaagggcaacgttgcctttcagaacgttggaatctaacagaagttaacatatgaaatcctgaatccactgtcaataatcctgcactgggatgacgctgggtttcctttattcaatacttgttgagacagtaagccagattagtaaatagaaagatggccaggatggttccgagatcttcaagttcaatggcagatcctttgtgtcctgattacattgccttggtttcatccaagtcaccagtttctgaggttttactagtcaaaacacaagatagaaactttagacgctatgattttcgttagtttacatccaatcctccaatctggtctggcaacgttccatttttaccaatccaaatgcaaagcaacttccaaagaaaagggtcatacgcgaatcctaaatcctgtttttacgtttctccatggccctgggagctaaaccaatagcttctgaaaccttcatgatccgcattcttttgcagaaatcaacaaacatctcccatgggacatcaccaacaagcatccagtctccgtctttgtcttcataggtaggtacatattctgaaccattcagcagatccatcagcttg

SEQ ID NO: 17228 - DNA, 811 bp, Picea sitchensis
  Predicted polypeptide sequence is orthologous to G450, G456
ttttttttttttttttctttcaaagttttgagacaattgcccttgtcaaagtttcaaaataaaatttacaattagcacccgctccactgttgatgaagacatggctcctaagctgtaagcatgctcagatccaactcaatgcagttattatattcctttgtagagagccaggtctgtgcttccaagtcacgtttttagactgtcggaattcagttttcacaaagtttaattaaaacttaaaacaaagcatcatagaaggactctcactgttcctgatggtatcctctcccatagtatactgccttcccaagtacacgagacctgcttctgacctgtgcataatgtctcattgcatatgccatcttccaatcatttccagaaaaaaaaaaattgattctaataacaaaggaccagtgactataatccagccgaagtgaatatggtaattataaccatgaagtgagcaagtctgaatgctgatcagaaacgaattagcctttctgctggccctgtttttgctgcaattgaatgagaaacatactcgacttcagctaactccacatccaccaactcatccccaatccatatgcccacagagtccagagaacaggtcatccttgagctttagctcctacttttacatttttccatggccctgggagcaaggccaattgcgtctgatcccttcattattcgaagtctcttgcaagaatcaacaaacatctcccagggaacatctccaacaagcatccaatcaccgtccttgtcctcgtaagtaagtacatattctgacccatgcagcaggtccatc

SEQ ID NO: 17229 - DNA, 745 bp, Picea sitchensis
  Predicted polypeptide sequence is orthologous to G450, G456
tttttttttttttttcaaaatcaatcatttcaataatcatatatcatttcaataatcaaatacactgaaatttctggatcctccaaactgtatttggttgaccaccatatttctaaactgtatttggctgaccaccatatttgtatactgcacataacttctgaaaaagccagttctataaatccataaattaaattagtcagcattccggagatggaggctcgatttcccccaccgtgggaacttgtacaatgaaaacagtcagtgctcatccgattccatgccggctcatcgtaatttctaacacatgcattagcaagtcaaaaaattatcataaatagtcagcttccacattcactgaacaacaacatcgtgcaaaatttttgagtggactctaatgcctgtttttacaattttccatggcccttggagctgtagcttccgaagccttcatgatccgcattctttggcaggaatcaacgaacatgtgccatgggacatcgcctacaagcatccaatctccatccttgtcttcataaataggcacataatctgacccattcagcacatccgttgaattgctatcgttcaacccaagggatccacacttgcccatggtaattaagcagctgaacatcttctccagttcaaaggagagttcctggtaggtgctgtacattttgaggtccacctttctgagatagggagctccatccatgctcaccttcacatacagagaattggc

SEQ ID NO: 17230 - DNA, 699 bp, Picea sitchensis
  Predicted polypeptide sequence is orthologous to G450, G456
ttttttttttttttttttggaaacagccaaatggttttataaaatatagacacagaattcaatttctgtgatcttgagctatcgtggatgaacatacacgcatattacatgtcaaagaataacaaaagcctgtgcggtattgtctaacaggttacaattagtttgagagcaaatttaaccaaaattctttaaatttgcacagtgaaattcctgtatccatgaacttccatttgattcatcatcggatactgaacagaacttgatgagaaaggcagatttgtaaatccaaaatatttgatgtgtgtttttgtagagagcgtggtcactgttttttacaattaggttgagattagatttgtagagaggctggggcgcgttgtaccccttcgacgaacttcttcgtttggaagagtaaacctgattgatttcgtggctgggcccttcgatcactgagatgaaccaaatctacaatctggttaagctcaggttccaataccatgcctgctgattggacagaccatcgtaatttctgatcaaatatgccggcccttggagctgcaacataccaatctgatcaaatatgtgtggaatctaattcctgttttcatttttttccatggcccttggagctaaaccaatagcttctgaagccttcataatccgcattctttggcacgaatcaacaaacatctgccatgc

SEQ ID NO: 17231 - DNA, 867 bp, Picea sitchensis
  Predicted polypeptide sequence is orthologous to G477
ggcccctccatctccttcaatgaagaatccagaattgcctgtcgaaatggatgaagtcgaagtcaaggtcgacattcagagcacaaatgccagtgccgacgagcccaggactgcaaaacgccagggtttcgaactcgccaggatccctgaagacccagcttcgaaacccactgcgctctcctccccgaaaaaacccaaagctgcttcttcttcttcttcttcgccgagagcgcagcctcccgcttgccaggtggagaaatgcgcggcggatcttgcggatgccaaggagtactacaggaggcacagggtttgcgagcaacattccaaggctcgagttgtgctcgttcttggcctccagcagcgcttctgccagcaatgtagcagattccatgtgttagaagagtttgatgaagcaaaaaggagttgtaggagacggctggcaggccacaatgaacgccgtagaaagactccctctgattcatcagttgacagactagattcaaatcatcatcttaacgacaactggttaagacatatgacggaatctgacaagatgacaatggtgctagagcggaacaccacagctaaagtttgcaaggagataaaaaatcattagactctgggcgtgctctctctcttctgtcatcctcagttcagctctctttgtgcagaacaaacatggccagagttatatttacaattcatcatattggattcttactgtcgatcatgaactgtaaatctaaatatctgaaatttggattgtgttgagcttaactcgcacaacatatgaagtccagaattcgaaagtctcatgacatttttgagcttgtatgctacgcttaaaatgttgtcattcgctttgta

SEQ ID NO: 17232 - DNA, 695 bp, Picea sitchensis
  Predicted polypeptide sequence is orthologous to G502
ttttttttttttttttttggacgggattaaatatagattgtgcaagcaaaagtgatcatgaaacatgagcatgatacccatgagtgtaatcaaaaatggattgaaaacaatcgctgcgttgagaccgccctctcttgtgtaattctagcgcaacaggcctgaagccctagagccagcatgacagcgtcgtatcaaattcgaatcctgcgttgactacgaggatgaggccgagcagtcggtctcctgtttcaggacatctgtgatgtctcgggaaacgggttgaaaactcctatttttcgagatcttcaatctctgacgattaagagcacagacggccctcgagattcatctccgctccagcggccacttccatggccggcttgtatgcttccacggcgatccatccactgatgcctgaccgaccatttgatgtgtggctgcctacgtgcctttgtttctggtgtgagcagccgaatcttcgattctagccatctccagcaggcggactttgggcgagatcctactgcaaccccctcaggcgttggtattcctgctggatggtttgggccacttttgcttcttgtcgctggatctgctcctcggtttggccgtgggcgttccctcgcgagtcaatgtccatagcatcgctggcaccatgaagaccaccaccttgagcaccgccgtcgactggggtg

SEQ ID NO: 17233 - DNA, 832 bp, Picea sitchensis
  Predicted polypeptide sequence is orthologous to G536
ttttttttttttttttgtactggaatgctgggcctctattagatattgaagcatttaatagccatggtatacacaccatgttaagacccacactgtcctactggtcttttgttccaatctaaaacttataaacaaaaccaggcgtgaataacaaagataaagagtgaatttgtaaatcgcagctgcagaacagaaaggatgatcagactcctgcctgctctagaatacatccaggccgacatacaagcccgtagatcttaacaacttcatttgtttctacatgtacctgctcaaacctcttcatccatcccgactgcaggatcatcccccttgacctgatcttcaactccatcttcctgaagatcagaggtccacaaagtgaggttatccctcaaaagctgcatgattaaagtgctatctttgtatgactcttcactcaacgtgtcaagttccgcaatagcttcatcaaaagcttgcttggccagatgacaagccctttcaggtgaattcattatttcatagtagaaaacagagaagttcaaggccaatccaagcctgattggatgagttggcgctaaatccgactctgcagtacttgaagctgtctggtaagctttcaaggactgatcagcagcttctttcctctcatttcctgttttgaattcagccagataacggaagtagtcccctttcattttatagtaaaaaacagtagattcgccaatattggaggaaggaatgaggtgttcatcaatgatggtcataatatcatggcagatcttagaaagctctgcttccactttctgtctatattctctgatacgcttcacgt

SEQ ID NO: 17234 - DNA, 803 bp, Picea sitchensis
  Predicted polypeptide sequence is orthologous to G536
ttttttttttttttttcaaggcaataaaaaatattattcaacacaaaggcagaatgggcctacagatttgttgatagactccaccaatctgctattacagtaccaagccactgtctccaaccattcgcaaatagtatggatcatttaaaatgccaacataagcgcagctaacaaaagatgattaaaaatatgctacccacagcaactaaatactgcagagcatgagatctaataaacacaatcgtgcacatagcctcctttaccaaacaatgcaggatagcctgctaatctaatcctaatatactaatagatcatcatatttcactattgctcctctccttcatcacgcttagaagtctctttgatctcatccccagcttcctcctgcatgtctgaggtccacaatgtcaaattgtcacgaagcagctgcatgatgagagtgctatccttgtaagaatcttcacctaaagtatctaattccgcaattgcctcatcaaatgcctgttttgcaagattacaggctctatctggcgaattcaaaatctcatagtaaaatacagagaagttaagggccagccctagcctaataggatgcgttggagccaactctgccgcagcaatatcctgggcagacttgtaagcaagcaaagtgttctcagcggcctccttcctctcggcgcctgttttaaactcggcaaggtatcgatggtaatcgcccttcatcttgagatagaagaccttggactccgcggcggtggaagaagggatgagatgggagtcgaggaggcggagaatgccctcgc

SEQ ID NO: 17235 - DNA, 879 bp, Picea sitchensis
  Predicted polypeptide sequence is orthologous to G536
tcgaggctccctcgttctttagcccctttgtcgattgtatgtgctgcaggccctttcagaaggacgagaagctagcgggaaaaggtgcgcctttgctgccgaggttttgtcttttggaaacacggatctctgcgttccttgacgctgttgaggattttgatcgttcggtttaggttttcttttcagggaaaatgtcacctgcggagtcttctcgtgaagaaagtgtgtatatggccaagcttgctgaacaggcagagcgctatgaagagatggtagagtacatggagaaagttgccaagacagtagatgtggaggaacttactgttgaggaaaggaatctgctgtcagttgcttataaaaatgtaattggagctcgcagggcttcatggaggataatttcctccattgaacaaaaggaagagagcaggggaaatgaagaacatgttactatgataagagaatacagaggcaaggtggagtctgagcttagtaatatttgtgatggcattctacgccttctggacacacatcttatcccttcatcgacatctggtgagtccaaggtattctatcttaaaatgaagggtgattaccatcgatatcttgcagaatttaaaactggtgctgagaggaaggaagctgctgaaagcacattgcttgcatacaaggcagcccaggacattgcaattgcagagttggctccaactcaccctatcagactgggactggcccttaacttttctgtattctattatgaaattttgaactcaccagatcgtgcctgtacgcttgccaagcaggcatttgatgaggcaattgcagagcttgatacattaggtgaagaatcttacaaggatagcactctgattatgcagctgc

SEQ ID NO: 17236 - DNA, 903 bp, Picea sitchensis
  Predicted polypeptide sequence is orthologous to G549
ttttttttttttttttatttcaaaccgaaaatatgtattaaataaatataatagagtttctttacaatgaagaaaccaagatgcataaccaaacatagattaacgagattacaatgatttatatctagtaattacgatttagcttggcctgacaactggagtcattgggaagttttataacttggccagatcattagagtcgttggaaagttttatagatgggactgtttgcttttctcgaagtgacagagctggcgtaattttgtaggaacataccaaattcgcagtttttcatgcttgttaaacacaccctcaatgtcccagccattatctttggccatggccacaagaggataataacaggcctgcctccaggctccaacgttttcccctcgttccttgtatgctcttctcagacggttggattgttcaacatccaggcaatgcagggcataacagtgcacataatgtctcatttttggcttgttgatataaccggcgcctgaatgctttgcatgtcgaaatacctgatttgtgacctttgtaggacatttttctcccctctccttcgcaatatgttgcacatccagcagaaatttcccacactgttcatagagatcaaatagatagtccaatccgttttttttccctcttgcaagttcaccaggctcagtaacaatgaatggatgttctctctgcctttcttcaccgtcttctcctgaatccttggaacgtcgtctcttctgttttttgcaaccctttgtctgttcgccgccatagttagagtcgggcattccaataagcccactgactgtagtgcctaggtggcaactgttttggagatgagaaccggatccattcctgcatttaggttcagaggaaagcttgctgatgtattattct

SEQ ID NO: 17237 - DNA, 704 bp, Picea sitchensis
  Predicted polypeptide sequence is orthologous to G557, G1809
ttttttttttttttttaataatactaaccgtccagcttaaacttagtgtacattacagattataatgtatgtacattattattctcattacagcccaaaagcaagctgatagttctagcatacatttttgaaagacacatgaaataatccagctttactgatcatcttcaagtgacataattcaatatggaggctcatatagtcagaggcagtgaggttcaaacacataattagaagtgtaccagcacgtcctaatactagtctttgttcttgatctctaaaaccagagaataatatctctggaactggtacacaattgtttattcatattgtactagtaatactctaactaaaacttcgttatctatgttgagtgtgaagttctctcgtgtgtgaaacactgcccaagaaaatgtaactgatgacagaaaggagagagcacacattctgaagggtgctaacaaatctataataaaagcaccttaagattactattcatattcagtatcctactacaatttaggtttctgcgcctgagttaccagatcctgctacaatttaggtttctgctcctgagttaccagatcccttttttttcattgttgtattcttcaaaatctgtctaagcatctgattttcattctgcaaagtggaaagcctttcccctaaactccgagtttttgtgctcaatttctttaacccct

SEQ ID NO: 17238 - DNA, 730 bp, Picea sitchensis
  Predicted polypeptide sequence is orthologous to G558, G578, G629, G1198, G1806
ttttttttttttttttttacatgaaatgaaacatccaccctcagctgatattgattcatggaatgacgaagatacatctgagtgtggccacccttcttttttataaatatgtacagaagtatctcggtgtttcatgcttcttcagtggtcaaatttcaactagtaatttcaaacactacctttctgtaaatcatgactaagaattttctatctgcaagcctgattagtagcatgcaggtgtgtaaagtcactgatcataaacatcaatgctgaatgttaatgttgcgtttagcatgagctggagactctgctctgctcagagcataaatcgaattaacaatacacaatgttgtgtaaatttctaatcctaaaacttgggctgatcccatggtagtaacttagacatgcagtgcaaattatcacgaaaactatggaccgaacctaattaattatccaataaaggcattggaatccacgaggcattgagctgatgatctgcaaagtgattaatactcattctctgggtctagctgaccaaagagagctcagtgcacgaagtcgagagcagtattctcctattgaaagtaagcttttggctgactggcgcgtggtgaggattctgtgcagctgttgcaatgtctgatgtctcagactatccgccaagatttctagattggcaagttttcccatggctatggccatttgtcccatataattggccatgtttgaa

SEQ ID NO: 17239 - DNA, 839 bp, Picea sitchensis
  Predicted polypeptide sequence is orthologous to G583
ttttttttttttttttaaaatcacaaatctcagcaaagttgaaaagttttcaaatacctgctctgtaaacgaacagttcagagaaaggatattttagcttttgaattgtgttcggaatgtttccattgtaaaaccaccttgttcaaacattgtggccttctggagttgcttttggcatgataaagatgcgggaattatctcataataacccttttgcagtcatctctgttctatggaaagactaccacaatgctctttgcatcgtaatttgtcgcttttcgaataaaatacatgttagaataagttgctttattgaataagcaacattaagctatgatactgtacacagtccttgccctttgcttctacaaataatcttgaattatgttacaaaatggtgtttccattgtgaaaatggcgttggacgacaccatcaccatttcctgtccgaaacacaattcacgatgaagcatgcaaagggaaattctcaatattgtagtgatattccactatttaattcaggtcagctactttcttacaaagcagcgcatgaagttgttcttccgtgtacaaacctctggtcattttaacaatgactgtctggataattaacgaatccttcacagtagaaatactcgcatggaggacttccaaatcaagttcttgcagtgctgtcatcagtctcgcaacaggatgattatgtttagtgcattgaattcttattatcgcctctcggccaagaatgcgaacttctgaattcaagccggggaacttcccctggctaaaacctttaaggtcaatacttgaaagatctgttgcttctttagctgccaacttca

SEQ ID NO: 17240 - DNA, 818 bp, Picea sitchensis
  Predicted polypeptide sequence is orthologous to G584, G1136
acgattctgccatcctgtatgttggacttagcctgctgcagctgcggctgctgctgtttctctttctcagtttccatatccttgactttattctggagttcctgaatgtaagaaatcgcatctcctaataatgaagctttgtccatctttgagatgtttggcaccacagctcgcaatgcataaaatcgttggttaagcttctcacgtctttggcgttctgcttcaacatgattgaggggctcttctcttccattagctggtttcctcccccttttccttggtcttctctcttcaaccaccacgggcctacgctccgaggcttccacatccgagtgttcctcggactccataaggggcggtcgagcagttactgcacttagggaagggccagcaacgctaattggcgaaattctgctagactgttttatcagatcacgagtattataaatctctccaccctcaccattactgatatggctccagtttggtgattgcaacccattctgattggcatttgtataagatattctctgttcgtttgttacatagggagcagcatgggaataaggggggcggaaaacggggtgataatgacgatctctctcttccactttggtgacaacagattcgctagatttgctgagttcttgcccaaagattttccaatcatgggaaggctttagaggtggagcagccttggcattcacagcattcaccctaattggatttggtgagaagggtgcaactagagaacccttcaccgttggttggcctcgatttccatcacaggcattttcattgaaactagatctaatctt

SEQ ID NO: 17241 - DNA, 636 bp, Picea sitchensis
  Predicted polypeptide sequence is orthologous to G597
ttttttttttttttttttatatgaaatatcagcgatagacaatcagtcaaagtacaagtcaggcgattcacaataacaatacaattgagtatcccaaatcaaaggctatgcatggtccgcagaccagtaaagatttgcatggtcctctgaatagcagtaccatccttcggagaacaaaaacgaagagttctttgtctatgctgccaagcatgaaatataacatgtcggatcttagttcttaaattaaaacaggtgacagctagcagagcagttgcatctgttccgagaaacctataaattttcatctgttagtttgaaaacaattgcagcccatcttaaaacctgttggtagtcagtgcaaattaactgataaatgtggtcaatattcagccacagggaaagatcctaaggcttctattattatccaccgggcaaagacatgttaatatctgtgttacgtctaggctctcccatagactgagagccttgccaacccactgactggtaggaggccatgttctgtattggctgtgaaggggcactattaaaatctccaatgctttgattcattggactacctggacctccagaggactcgctcattgttccccgggaaacaggactagcagctgcagc

SEQ ID NO: 17242 - DNA, 730 bp, Picea sitchensis
  Predicted polypeptide sequence is orthologous to G602
ttttttttttttttttctcaacatatgctgctttctgcttctccaacttctcctcagctcttttcatccgagtttctgcagatgacttcttcgtattttcccatgctgtaatggttgacacagacttgtagtatttgttctcggcttttgccttttcattttcttcccatgctttgacgagagccaatctcttctctgtattaacctttactaaaaaagcatctctgtctaaagatcctccttctgagcttttcgatagaacaggctcaacagctgcttcctttttctccgtttcaacaatcgccaaagccttagattcatcaccagtggcatgtttttcctcagaaaccatcgcaggctggtcagaggcagtattttcttccaggacatccttagtgacaataggagctgaagaattctctgatggagcttgctcttcagccatgtctaagatcctccttgtgatatcgtatttcttctatagcaacacaactccgaaaacagaagatctgacgagatttgacctggccgatgccctgcagtccctgttttcttctgaattctcaagtgagtttctagaatacaggcaccgtgtatattctgtgtatgttccaagtacgctatgtgtatatcctagcagatggatggtgggtaagaggcggccatcacgtcttataagacgtgatgtcgaactagaaggaaatggattaggttggccaatcgggggggg

SEQ ID NO: 17243 - DNA, 780 bp, Picea sitchensis
  Predicted polypeptide sequence is orthologous to G602
ttttttttttttttttaaatcaaaagactgagattcctaagtggactacaaaatacatattcttctaatcaagacttgtgcaacttgatgccatcaaatgtgttcgagaaatacagtcaaatgactacaatctttctgatcaatattctacatatccaaacaaacaagatattcacagcaattgtaatgaaaaacttgctagcccccaaagcagagaaagaactttttcggcacctgacctgttgcattatatttggcacttgactcttctgccttgagcatatcctctcctcgtttagcctcagccatggccttcttttcctctgcctgcttgtggataatagcaatctcatttttcattttctcaacatatgctgctttctgcttctccaacttctcctcagctcttttcatccgagtttctgcagatgacttcttcgtattttcccatgctgtaatggttgacacagacttgtagtatttgttctcggcttttgccttttcattttcttcccatgctttgacgagagccaatctcttctctgtattaacctttactaaaaaagcatctctgtctaaagatcctccttctgagcttttcgatagaacaggctcaacagctgcttcctttttctccgtttcaacaatcgccaaagccttagattcatcaccagtggcatgtttttcctcagaaaccatcgcaggctggtcagaggcagtattttcttccaggacatccttagtgacaataggagctgaagaattctctgatggagcttg

SEQ ID NO: 17244 - DNA, 744 bp, Picea sitchensis
  Predicted polypeptide sequence is orthologous to G618, G2057
ttttttttttttttttttttaaccatcaatataggtatattatattgatgatggtattccatacaagcaaaatgaatgtatcaaaacataaatcccatacaagttatactctcaaagttgctgaaacaaatatataaaattcaaagtttctattgaaactttttctattcttaaattctaatctattctgcctcctctccccaggttgtctttgccactggatcaaacaaaaatttctctgctctgctcctgcctttctcagtcccaaaatcagcggattcaagctggatgaaacgaaacagggaggagcgaacaaacctggtaaaaaagctgaagtagtgtgattaaaaacaaaaattcaaaaaagccggggagggcttcacatcggcgttctcgtcaatgccctgaattcgtgccggaatccggaagcccgaaaagccgtcaccagtctgaggacattggccggcggcggcattatcgtgcagcaacggagggttaaatcggacacaaacaggacttgaactggactgaagggttcccctgagtgttaatgagttatagtggcctcctcctcctctcatcatattaggcgccgatacagcaatattattagtgttattgctcccaaaatctgtatatatgctgttgcagttccacaccgggggggcacttgatattctgtgaggctgaggctggctacttaaaaactcatgatgaagctgctcctgcataacaatctctccc

SEQ ID NO: 17245 - DNA, 596 bp, Picea sitchensis
  Predicted polypeptide sequence is orthologous to G635
ttttttttttttttttttcaagaaagaaattatattaatgtttacataggccaatagagcaagagccagacaagttgtacaacttcaccctattataacagagatcaccctctttcagtgccttgaagaaaaaattatattcatgttcgcaaatgatcaaattaaacaagttgcacaacttcatcctacgcccattccgacaaggtttaccctgcttcggcagagcggccggggccgacggtggcagtgagctctgcgtaataagggctctcgctccgatccctcttgccatcgctcacatccttgaactctgccatgagcttgtcccacttttctctgcactgtttcccatcccgcttaataccctccgcccccaaaagctcagcaagctcttcccacaacgccgcccgcctagccgacttggcgaatctcgactccatctccgccctgaacttaattaaccgcagaacctccgctcgcttccaattctttgacctcttcttcggccctccaccgccgccgacgacggtaatagcagctgcgccagcgtcgtgatcagtctgttcagaaccccccgtggtcggtttttttttttt

SEQ ID NO: 17246 - DNA, 686 bp, Picea sitchensis
  Predicted polypeptide sequence is orthologous to G651
ttttttttttttttttttaattgaaaaacaaattgatgatttgctattagagaagaatgaattaaatttttgtaactcatacaaatatgtagaatgaatgccaccagtatatctagattctgtggacatccattaaactacatgaatgggaaagaaccaacgaaatccttgtgcaagcgcacgtctaatttactgttgtaatcaagggcaaaccagctcgtttgcagcccagatctcggcccctaacaaatccagtgttgctcctgaattgactatctgcttcatcctctttaaccacaccaggctgatggctctccatccaccaaggttgagaggatttataagatatgagtttgtagtcataaggaggccaattagtagaatccaagaagtccccacctaaattgacagaaactgcagagctgtgctgcacttgaatgcagtcattttcatcttcagcaggcatgttcagatccaactcttgggtacttctaatagctgaaaggtgctgctgctcgatgttggaaaggcttgtagaggtgtttgtactagtagcagggggagtggagtgagtcctcttgtgaccgcccaaagcttgcccagatgtaaaattcctgtgacacacagggcattcgtgcatccgaactttcttaatctcagtgtacaaactctgcttataagtctca

SEQ ID NO: 17247 - DNA, 465 bp, Picea sitchensis
  Predicted polypeptide sequence is orthologous to G652, G1335
ttttttttttttttttgacaaagagcacggctttattacaaacttcaattgcacgcgctacctacacaaatatatagaaacttaaggcgggtaaggcggtaacggcccataagtcgcgcgggagccaggcggctgaccgccatcgccatagccgttcttagtactaaccaggcggcgaaccatatccgctataatccttccagaatagtactcgccatcgccacctctaccagaacccgaacgccggtagccactcccggcttcaccgtagctgccaccgctgccagaaccggcacgggaagattcgctgtggccatatacatggccagtacagagaaacagactcaaagcaagcacaaatatgcagagaaatttagtcatgctggtcgccattatcgattatatctacgatattgagcctcgggcagagctagtttaagcgctgatcgggggggggggggatta

SEQ ID NO: 17248 - DNA, 852 bp, Picea sitchensis
  Predicted polypeptide sequence is orthologous to G652, G1335
ttttttttttttttttttaccttattaaagagtttaaaaaacccaagacagagcaacagtgcctagtagaactaaaggagatcaagcaggatgttggagaatctatctaggactatgaccagaggttcaaggacttactaggcaagttgaccttcagaatacaggacatccaacacagagaatggtttattgctggattgttgccccacattcgcatccctcttacacagcaaaagatttcctcccaggaagacgcgttggagatagctataaggttggaatccacaccaggaggactcgtcgagccctcatcaggcttggcgcaggtgcataaccaactggccaccttgaccaaccagctgcgggagatataaagaggaaaagcagtccgtaagaaggtgtggtgtactctgtgcaggacagagggacgtcacagaaatgagtgcccactccttggaaactataatagtgcgacaggcgcgttgaatccatttccctacagaggaacctctaattggtgcgatatatgtagagcttggggacatgagcctactcagtgtcctatgttgcagaaatctcaaacttccactaagacacccttgtgtgatctttgtaagtctatggggcatgatgtgaacaattgcagatctttggagctgatgaaggagtgcacatcagatgcttaccgtgtgcagggaacataagacaattcgggagcaggacggggaggcttaaaaggtggttacagaggtcgagaacgaggaggtgcatccacttgttataattgtggggaggttggacacatttcctgattctgtactaaacctcagccacggtgcagacactgacgcc

SEQ ID NO: 17249 - DNA, 625 bp, Picea sitchensis
  Predicted polypeptide sequence is orthologous to G653
ttttttttttttttttgatggtcgactcttttattggtgttttttataaaatagtaaatataatagaccgataaacaaaataaattaagcgatagcgataaataaccctaactataataatttaaagaacagattggcgtgcggcagtgagacgccgctgggtggccggggtgtggtggcgactcgctagcgctgctggtgactgctgcgctcaattcgcgtcactcttcagatggtctccgctgtccatggaaagacagcctgcgccaccgccgaagccgtagcctttgggaccgtatttgcggccgtggcagtttttgcagtacagttcactttcgtgttctgcggcattggtggagtccagcatcttctggcacatgccgcatttgaagcacatcttgtgccatttgaatccgccggcgacgcgctcctcagccgcgtacacggacttgccgcacttcgggcacttcgggttatctgctggtttgaaaggcattgtgctcgcttaacttatcctgttcgttgattcgctacgagagtctagctcccgaacgcgtgtacagtgcagggcggtgctgccgagactgcggtgcgcggaggtcgaatgatcgggggggggggggat

SEQ ID NO: 17250 - DNA, 908 bp, Picea sitchensis
  Predicted polypeptide sequence is orthologous to G653
gatctgcagcagaacgggttggaatggagttttagaagcatcagattgattattcgctgaagaaaaggcacggaacttgtctgaatctgctgtggagctgccagatcttgtattctgaggcgaaaactggggcgagaaaggttttcacggctatttagaacgcgagggctcaagaccgttattttacaataaaaattatcggatcgtggctatggccttcaccggaacgcagcagaagtgcaaagcttgtgataaaacggtttattttgtggatcaactgtccgcggatggagtttcttaccacaagtcttgcttcagatgtaaccattgcaaggggacgctcaagctgagtaattactcgtcaatggagggagtgctatattgcaagcctcactttgaccagcttttcagagagagcggcaactttaacaagaactttcagtcccaaagatcaagcaaagtaattgacggactttcacctgaactgacaagatctcctagtaaagtgtccatgatgttctctggaactcaagacaaatgtgctacctgtggaaaaacagcataccctcttgagaaggtcactgtggaaagcttatcctaccacaagtcttgtttcaagtgttctcatggggggtgttcaatcagcccttctaattatgctgcactagaaggcatactgtattgcaagcatcatttttcccagctcttcaaggaaaagggaagttacaatcatctcatcaagaccgctactatgaaacgagcagctgcagtacctgaggtagcaagtgcagtccctgagatataacgttattgtgatctagttacttgattatcatttgtgtttgtattttgaagaagttacacggtatgctagtttgttggggaaaagagacctgatcctctctttg

SEQ ID NO: 17251 - DNA, 349 bp, Picea sitchensis
  Predicted polypeptide sequence is orthologous to G663
ttttttttttttttttttaattcaaaatagaatggtttgcctctttaatgggaagaaatatacatccagtaacaaagttggttcggcctccctttcattgtatcaggtgtcattcaacaaaggaaataatgacaactacgtttgaattttatcactttctcgtgtccattggaaaagtaggcacacaacctcaatttcccatttcaagagaatgctacaatagattatgtaaccttaaaattaagttgattcaagttctctttctaaagtttgaactccggcctttatagcaaaatggagcaattttatttacagctcgatatctgcatcattactagtgcctttcccc

SEQ ID NO: 17252 - DNA, 792 bp, Picea sitchensis
  Predicted polypeptide sequence is orthologous to G715, G1646
ttttttttttttttttcttggaaaactagctgataataatattaaaccctttgattccaaaggggcgatatatttacagctcagaattgaaacccatatagaaaatagtagaattgcatagtaatcttgaaactattggaggacaaccaagcttacaatcgaaatgccatttctgatcaaaagccaaataaaaaagaaaaagaaaaagaaagaaaaaaacacacgcagcatgccctcaaaccctgacaaatttagaagttagctcaacttccagggttaggcgacttggattggtctgcctgcatgtgtccccattgccatatattaggcatgtaggccacgggagactgcggctgctgcatataaatagtgggatccatgggttttccaacaaacacaccatgaggcacagaatgctggttgggtaaataatagtaaggaaaagaattagcaccagcagcagcgttagtactgctgcttccaactgagagagcagatctagggtttccaagattaataacctgatcctccttcaactcatcccggggaacgatatcgatcagaaaatcgaatatatcagtcctggctatggccgcggctatatcgttcttctgcagggtccgtctcttgttttcttcagtgtgaatccaggccctgagcgtaagttcattgatgaacatctcgcaagccttggcaaaaactactggagcctccgcagatatcatcctgacattctcgtcgtctgacttcattatcttcttgattctcgccagagggagactgtgattttct

SEQ ID NO: 17253 - DNA, 795 bp, Picea sitchensis
  Predicted polypeptide sequence is orthologous to G715, G1646
ttttttttttttttttgaaaaaattatatcaacgtagtaacaaaataggaaatccaaaaataagtacatgcatctttccgaaaacaagagatacaaaacaaaattaaggttaagctctagcccctagtgttaaaaaggaaacatcaacccgtgggtgaaaatacacttgtcttctcagttggcagaacgaggaggggttccataagaatgctcatctgtcatctgatgttgcccataagactggccatccggcaagtgctgctgctgctgatgtggatgtccataactttgtccgtcgggcatttgttgttggtgtgggtgaggatgatgagggtgctgccacatgggctggtgaggatgaggaggcataccatagggacggggtggctgctgctgctgcatatacatggcggatgggtccatctgaagtggagcaggtctgcccatcattatggaagaggggcccatcattccctgttgatgtggcgattggggcatggaaggaggagggtaatagaatgaaccctcgggggtcacgccacctctggcaaaccctaaacccaaaccctcctccttgaggtcgtccctgggcacaatgtccaccaggaaatcgaatatgtcagttctggtaatggcagcggcaatgtcgttcttctgcaacgttctccgtttgttttcctcggcgtgaatccatgaacgcatggtgagctccagaatgaacatctcgcaggccttcgcgaacagaacgggggcctccgccgatatcatgcggacatcctcgtcggccttcatgat

SEQ ID NO: 17254 - DNA, 854 bp, Picea sitchensis
  Predicted polypeptide sequence is orthologous to G715, G1646
ttttttttttttttttagaaccaactttagcagataactaaaattaactttatcttattcatgttcaaaccctttaaagaagtaacttgtttaaattccattcttgattgtattttctgtgctttatagccaaaccctcgtcttcatcctttcaaaccaagcataaatccatctggtggccatgaaaagatttttaataaacacttattttgtcaaaatatagctagggataacgagaccagagtattgatcagccttagtatctgataatatataagagaccaaccaataaagtatatcccccaagctgtatctcataatcaaatgctgtttttgagaaaatatggctgttctgaggatgctatctaggctcgagagcaatcagcctgatcattcttgattgatactctggcttccacccaaccttatgatcattgctgtggaggttggtacatcaactgctggtctggcattaaaggctgctgagacattaattgctgagacattgtttgttgagcagtcatcacatcaggattaagattgtggtggtaaggctgagcatgcatgagtggaaagtgtatccctccataagacatagattctgcatgaggaatcccaggccagtgtcccccatattcctcatccttgacttcatctctaggaacaatatcaagaagaaaatcaagaacatcacccctgcttatagctcctgcaatgtcatttctctgcaaagtacgtcttttgttctcttcagtatgtaaccatgaacgtaatgtaagctccaaaatgaaaagctcgcatgcctttgaaaataggacaggggcttcagcacttatcatcttaacatcttcatc

SEQ ID NO: 17255 - DNA, 830 bp, Picea sitchensis
  Predicted polypeptide sequence is orthologous to G715, G1646
ttttttttttttttttttcttttttttttttttttttttttttttaaagaagtaacttgtttaaattccattcttgattgtattttctgtgctttatagccaaaccctcgtcttcatcctttcaaaccaagcataaatccatctggtggccatgaaaagatttttaataaacacttattttgtcaaaatatagctagggataacgagaccagagtattgatcagccttagtatctgataatatataaaaaaccaaccaataaagtatatcccccaagctgtatctcataatcaaatgctgtttttgaaaaaatatggctgttctgaggatgctatctaggctcgagagcaatcagcctgatcattcttgattgatactctggcttccacccaaccttatgatcattgctgtggaggttggtacatcaactgctggtctggcattaaaggctgctgaaacattaattgctgaaacattgtttgttgagcagtcatcacatcaggattaaaattgtggtggtaaggctgagcatgcatgagtggaaagtgtatccctccataaaacataaattctgcatgaggaatcccaggccagtgtcccccatattcctcatccttgacttcatctctaggaacaatatcaagaaaaaaatcaagaacatcacccctgcttatagctcctgcaatgtcatttctctgcaaagtacgtcttttgttctcttcagtatgtaaccatgaacgtaatgtaagctccaaaatgaaaagctcgcatgcctttgagaataggacaggggcttcagcacttatcatcttaacatcttcatcagattc

SEQ ID NO: 17256 - DNA, 570 bp, Picea sitchensis
  Predicted polypeptide sequence is orthologous to G732
ttttttttttttttttttcaactcgacctgctatgaggcctcttcaatatccattgcatcacaaaattgtacagatgatctaaagatggatatggtggtggaaggcttactgaacaatatcagatgcaactgaagacttaacagaagcctgaattctggaactccaaattatcaaaattacccaaagattgctgctgctgctgctgctgctgctgttgcatggagatcagaacctgaagcttctgatacaaatcaatggcttgagatctgagaacacgattctgttcctccacctgcaaataatgctgcgaggcgatattgaatttgctgagaatatgattgttttctgccctcagttggactacctgagctcggagctcgtccatgtgctgttgtttcctcattctggacctccttgcagattctctgttggataacattctcttctgctttctctcatcgattacattctttttctgctcctgctgctgctcctgttgctcctcttcagagcccgagtgggaggagctgggaggacaagacccataactcatgctgctggaagatcct

SEQ ID NO: 17257 - DNA, 895 bp, Picea sitchensis
  Predicted polypeptide sequence is orthologous to G735
ttttttttttttttttagcactaaccttttctatgaagtaaccattacaacccgtatatgtaatgacttctctaaatttcatttgtaatttacacatgcagctttgttgtttctcagaatcaatgaatgtaaacttgtcaagaaaataactatagtgcattgttgtgcgagtccaaaatgatgtactgtacaactagagcaggccaaatggattttcaaatctaactttgccatttttcttctataatagtctgtagcccgatggcatgttgacctttacactccacattggatggaaatgtaaagataattctgggaacttctactgctgctgaaagattagatgaccagtaacttactgtccaccattctcaatcctaggtgagccttcaatatcccagcctccactccatggcgtggatccacaggtcactcccccacgaattcgcttctgtaaatgttctaaactcgcaacccgttgcatagagggtgtccgccccattttggttccaacattctgtgttaatagctctttattccgatcattcatattagaaatatcgcaaggcattccttgagttgagattggctgtccagaatgtgagtatcgactagaatcctgcagaccagaagttacaggtgattctagtggaccacccatatatcgcatgccagaagcttgtgaaatctgggctgtgttttgaattgaatgaccaacaccagttgccctggctaccatatcttccgccatcttcacctttgctctcaatgcttccacatctgctctcagaattcgattatcaacagcagcgtcattgtacttctgactcatctcagtgaggcgcttgaataaagaagcattttctactcttaattgtgcaacctgcatctcaag

SEQ ID NO: 17258 - DNA, 626 bp, Picea sitchensis
  Predicted polypeptide sequence is orthologous to G773, G1412
ttttttttttttttttttcaaacatgaagtgttttattgaaaaaattcaagaagcgaaaaagacaccgcgctttgactgccagtgatcccacgatacaagctacctcatatgatgaccacacgtttcctgtcggtagtgggcagaccgagtcaaggttccagacccgactctcggtcgatacacgtcatcaaaatcgggcaccgcgcctgccgggtatggattcgaagattgacgggattcccagtgttttgctacgtggcagggtattcggaggacacttcatcgccgttgaaacccagagacattgacacgtggcttccgccctcggatgaatttcgctgcggtaggtcttcctggagcgagcttaaagactcagtagaagacacggccgcgttgttggcatctgacgtggcatggctcagtaagctctccataaacggaccatctctgagaagcagcctagagaaggaactgaatttgagcatcgccgatttttgtcgggtgcgtcgcaggtcaggtgacagtgcctctacatcctggcacgaaacaaccatgggagaataacttactttctcgtatatccggcacagcacccaatcgtccaatagcattgatcccttcctct

SEQ ID NO: 17259 - DNA, 811 bp, Picea sitchensis
  Predicted polypeptide sequence is orthologous to G773, G1412
ttttttttttttttttgcttagaaatacctttaaaaatatttttaactgtacaatacagagcgaaggatcccatgccagaaaatggatcatgagcatacaataagtaacaagcgtacaaatagtagataataaggccggaatataaaatttaagcagccggaatccgtggcccgtgcacgttattgcaggggaggaagagattgaatgaagttagaattgccagtgttggtaacttccgttgccaatggcaaaagctccatgggtaattcagagcagagcagaatgaatgaattatctctaaagaagctctgcagccaggcttgcaaaaaacgcactagaattggctcccaaggatggcatatgctctaactgttgaggaaacgggttctgcgccatctgatcatagttgtatccgaattgctggtttctccagaacggtgaattctgaccatattctatcgcctggcctccggaattagaaccggcatctgcttctgcacgggaatattgttgctccgtctggttgtagttcggatctggcatcttcatgatctccctgctggggaatttcagaagagagtttattctgttcagggaattgattcgcggcagattgatgagcagcttgttatcgtccatgtctggaggggaattcgatgcaacgggtgccatatattgatcttcttctggatctacgcatgatgataactcattgctttctttaggcacggccttctgactggcgtagtgcttttcatatattcgacacagtacccagtcgtccaacctgatgcttccttttctctttgc

SEQ ID NO: 17260 - DNA, 845 bp, Picea sitchensis
  Predicted polypeptide sequence is orthologous to G791
gaacttttacaacttgtattgttggccatgaaaacagccggggagatctgaattttctactaacatctgtgttttcgccggttctcgcttggacctccataggacctagctggaaacctcgaatctcggccggtcattaattatttatatttttaaaacggccggttgggtagattagggtttcagatttcaggagggcaagtgttcgaatccgagagaaggcagaatgagctctccgcagagcaataaatggctgtcgtacttcgacgagccattgttggatgaagtgggcgtggggcagccggccaacccattcttctggtgcggtccgggcatcaatgatcagcccgatgtaagtggcagtgtagaaattgatggttccaataaggacatagatgagcaagaaaagttatgtcctagaaagaggccacgggaagaatcaagtggtggacctgggtcaaaagcttgccgtgagaagatgcgaagggacagacttaatgataggttcatggagctaagctctgtgttagaacctggtaggcctcccaagacagacaaagccacaattttgtctgatgctgcacgtgttatgagccagctacgggctgatgcacagaaactgaaagagtcaaatgatcaccttcaggaaaccattaaagatttgaaggctgagaaaaatgaacttcgtgatgaaaagctgagattaaaagcagaaaaggagagattagagcaaacagtaaaagcaatgactttgccctcaggctttgtgccacatcctgcagcattccatgcagctgctgctgcttttgcagctcaaagtcaagcagcagccaacaaaactatgc

SEQ ID NO: 17261 - DNA, 859 bp, Picea sitchensis
  Predicted polypeptide sequence is orthologous to G791
ttttttttttttttttatcatgaaaagtagttatgtgtcttattgattccaacgcaagcaaaggaattcttatccaaatgtgcaatgaatttgacatcttcctggaacagaaactggaaccacgagaagaccagactattctcagctgtgttcttgtttatacgccagttgggaataagtagccagtggccacccaaagctcacgaatcattctgtttaagattcaatttaattactcaagttacagtactgtaggaatgagttcaaccccacaacagaaagaagacatgactgtagaaatgggagactatcaagatgatgcaaagcgataacactaaaacataacacctgagaaaaagtcctagttttgctggtcataatagacaccgacaacaagtccatagatgtggtaagaatgtgcttaagcaacaggaggccttagcgcatgatcctgagatgtatctactgcagcaggtggcatccattgccacattgccattccaggaaaacctggaataggtagggtcttgctatttgctgcttgactttgagctgagaatgcatgagatacagccagatgtggcatgaaccctggaggcgaagtcatcatagccttcatttgttgatccaatctttccttttctgctttcaaccttgtcttttcatcacgaagctcatttttctctgtcttcaattctttaatggattgccgaagttgttcatttgagtctttcagcttgcctgcctcttctcgtagttgattcacaagagaaagagcatcacttaatattgcagatttatccgtctttggaggccggccaggttccaacaagatgcttagctctgtgaacctgtcatt

SEQ ID NO: 17262 - DNA, 828 bp, Picea sitchensis
  Predicted polypeptide sequence is orthologous to G831, G1202
ttttttttttttttttcgttataaaatcatatactgttctgtgcatttataaaaaaaaattgaaatattacattaattttgtgtaactatagattttaaaggcaggtgacaataaatctttcatgactcaggaggatattcttctgtacattccttccttttgtttatgtaattgcttccaacaaagaaaatatgatttccgtactaactcatcctcaattgcattaaatgcatcaatctggagctctgcacttccaagttgggagcggctactctcatgaactcgaagcatctattagatatccaaattaccactatgaaatttcctctgattgtaccttgatatcaatcaatcgtgtattgttaagaaagagaatcttttctgcactaaaagggcctctctcattgtgtgtgagctggctttgccatctcattctatcagttattttctttactttgacaagaacatccacactgtcacgaatgataactgctccttctgggcgtagtatacggtccatctccagaagaatgtctaccatatcacacctatcctggtacatgctgaaaatgccattggcatgaataaggtcatatgtcctcgggtatgttgaaaaggcttcacaccagtccatgtatgttccaattagccctcgttcataaatgatgccaagagtgttgtttttagcatctgccgggacaacattcattacccagacttggtagttagccaaggcagcagcaaagcctcccaacccagcattcatgtccataatgttatgatattttccgtcggtgagcctttctataaatcgtctatagtatatt

SEQ ID NO: 17263 - DNA, 569 bp, Picea sitchensis
  Predicted polypeptide sequence is orthologous to G843
ttttttttttttttttagaaagacacaaggaaagatatattattaatgaatcaatgagtggctcattcctcaccctgaatccagcccattcttgaaagcaaatcatacactctatccactttgtcatgatcaactttaaaaaaacgatatgcatcagatctttttacagaagagcctttcagactctctaacattaaaagttccttcattttaagataatgggccggtagtaatctattctgggtgcaaagttgtcgttcagtaacagatagcaactccgtgcctggaaaacccattatgtcccattgtattaacgatttctttgttcccttttgccctgtagctgcaggacatgtgttgttgcctacaggtgcctgccctgcggtactctttatcttttggttgtccaccataccccctggactaccatctccttctcctctttctctgtttgtagtgcggtttgcacgctgagctacttttgcacttgcagccatttgataactttcctttgattttttctgattggcttcagcctctctcttctttttctctgctgcgtattgttc

SEQ ID NO: 17264 - DNA, 729 bp, Picea sitchensis
  Predicted polypeptide sequence is orthologous to G852, G2633
ttttttttttttttttttcgaataaataatatattaaacaaacagaaattgaatcattttttatgactcccagagggtgcaacaacaaagttatcaaagactttatttgccaacttcaagccaggaaagcacttcttgaggtacctgttcatttggaattttgtgtagtcactttctaacaaaatcagccatttgtctatgaaatccctgaaattaaaccaatggaatagtacaagggatttcaccaaacaagccttgatgacataagacatatttcagtaagtagcctacaccacataacattgttagatcaagctatgaagttactctgtggaatacagggtagttctgtcaatgaactgttcgatggtgctttctatgcattcatgttggcactaaatttacccgacactttagaaaattagtttttccagttaaacaaggttttgtaataaattactgccaggcacaagctgcaatcaaaggcctatttgaccagcctagataaagagtgtcatccctttctaacagactatacttctgacaataaccctccaagagagacttgatggtagagttaacaatcgagcttaaggggtaaggcttaaagccagccatggtgaatctggacttccacttacccattagttcatgtctttcaaccctttcagctccttcacaagcaatgatattcacaatatcacgtgccaaacagtgctgctcaacatt

SEQ ID NO: 17265 - DNA, 815 bp, Picea sitchensis
  Predicted polypeptide sequence is orthologous to G852, G2633
ttttttttttttttttttgagacaaatattttctatctactgcacgagaaatccgaacaatactgatatttgaccttaagttttagttaaggaatctgtttcctcagacacatgtttcagttcttgaaatgaggaaattgattaattaacatcgcgtgcagaaatttcagttttggtaattcccaaaaacatttttttgccagtaactttaattacaacttttgaatttagccataatagctttgataatcttgtggctaagcaactttctccatacatacatgtctatcgatgaaatatgacatgcactgttaaatgttttcaataagttagcccaagtcacatgagaaatacttaccttcgctaggagaggctatgttaacacattacttccatgcagaagctacaaacaagtccctgcctaaccaacccagataaagaacttcatccttttctaccaccctgtaattctgattataagactccaaggcaaccttgatagtggagttaacacgtgagctcagagcgtgagatttaaagccagccatagtaaaacgggacctccacttaccaaaaggctcgtgcctttccactctttcagcaccttcacatgcaataacattcacaatatcacgtgctagacagtgctgctccacactgacacgctctttgctttcccttggcagagttaaatccaaagattcaaacatagcagtataataactcaaagtctccaagaatcttggaaagaaacgagaagtattagtattagattcttgctccaccaacgttacaacagttggagccaagccttc

SEQ ID NO: 17266 - DNA, 627 bp, Picea sitchensis
  Predicted polypeptide sequence is orthologous to G852, G2633
ttttttttttttttttttgaaatgaaacaatcaattattaacaaaatcgtgtgcattaaagccagaagcaaagacaactcaaaaaaaataagacaagtccgcaatcctttgcttttcagtattggtattcccaaataccaaatttgtgggaataactttactttcagattttgaatttagctataccagcttcgataaccttgtgactaagcgactatctccattcatacaggtcctatcgatgaaacttgacatgtactgctaaatgttttcaataagttagcccaagtcataaacaaatactttccttcactaggagaggctatgttaacacattattacttccatgctgaagccacgatcaagtccctgtctaaccagcccagataaagagcttcatccttttctaccaacctataattctgattataggagttcaagacaaccttgatagtggagttaacatgtgcgctcagagggtaagatttaaaaccagccatagtcagacgagacctccacttaccaaaaagctcatgcctttccactctttcggcaccttcacaggcaataacattcactatatcacgtgctagacagtgctgttccacgctgacacgctctttgctc

SEQ ID NO: 17267 - DNA, 853 bp, Picea sitchensis
  Predicted polypeptide sequence is orthologous to G861, G1140
ttccggaggataacgctttcgaagtacggtgttgaattatctcgcttgactgaaacattttagggttattctccacaagcccagttttcttgccctttaatcttcttgtaagccttcggatttggcggaaaattttcccttccctgtgtatgatctgtatgttaatagcgagacatcttgcctgttgttgtaatctcagattggagtgacatggcccgcgagaaaatagagttgaagagaatagctaacgcttcggccaggcaggtcacgttctcgaagaggcgaaaggggttgttcaaaaaagctgaggagctatcgattctatgtgcagcagatgtagccctcattgttttttcttccactgggaagctgcacgactactccagctccagaaatatgcatgggaaagaacttgaaggattatctctaaatgacttgcaacaattagaagaacaacttaagatggggttaaattgtgttcgattacaaaaggatgaatatatggttaaggagataaatgagcttcaagataagggaagacgaataacagaggagaatacagaactccatcgacagattacataaatcgcccaacaaagactatgaggattctgatacttccttgcagctggggttatcttcgcagtcgaaaatttgagactcttgcgtcgtatttcaagagctgcttcatatttctattatggacagttagccttctttattatggacagactgacctgaatatactctcacaccttccaacccaagtgttttttataacagtttgcccagatgatgttatatataatcaacataatgatttaaacaggttgtaatatgcaagaagcataca

SEQ ID NO: 17268 - DNA, 785 bp, Picea sitchensis
  Predicted polypeptide sequence is orthologous to G861, G1140
gattccttctctccaaaggcgccgcaggagcgctcgctctcgctctcattgttatcatcagaagcttttacccaccattcagcgctttcagcatgaagcgagctttggataataattccaagggtcaagcaaaaagtaggaatgagtgtggtaatgaagaattgataaatctccatcgagaaattgaaggtttacaacggttgattagtcaagtgaaaggcgattggcttgatggtcttggattaaaagagcttcaacaactagagcaaaagcttgaaactggattgactcgtgttagatcagaaaaggaaatcaagttgcgtgaggaaaataaaaacctacgtcgtcagataaaggagttatgtggaaaagcactccaagatcccgagtcatctgaatgcataagcaatttggaagcactccaagcttatcttgaagaatcttctgagtccgatacttctttacagttggggttgtgaaggtccatcaaaaatacagtaaaagtgcttcaatgggggcatactgcagacatatcatacaaactaattctctttgatgacatttatggaatatagatttatttaaaatatgtatatgatacagacattaaatataaatatatgcttgagttgcttgcaactttaagtgagtaattccttacaatgttagtgatattaaatgcctaataattccttacaatgttagtgatattaaatgcctaatcaataattatggattgcattccttacaatgctaatgctattaaatgaaaaaaaaaaaaaaaa

SEQ ID NO: 17269 - DNA, 815 bp, Picea sitchensis
  Predicted polypeptide sequence is orthologous to G872
tccgattcaaatcccgttcatcccatcacgcttcacgagcacgtcctcagttcgctgcccaaatacccccacatgactaaaccctcgccaaatcagaacagccacagcagacccgaaactcgctcacttaagtcgcggcagttcaagggaatccgaatgagaaagtgggggaaatgggtgtcggaaattcgaatgccctattgcacgggcagaatttggctcggctcctacgacaccccggaaaaggctgcccgcgcctacgattttgccgcgttttgcctgagaggatcgaaagccaagctcaattttccccttttcacgccgaaaatcccctgcgcctcttctctatcaccgcagcaaattcaagccgctgccgccaagttcgccgcggaagagttcgagctgccttccgaagatgacgcggagttttcattctctggttcggaagcggaatggggcaatgacggccaacagatttgggaggagaactgtccggcattttgggattcgatactgctggaatgcctggagagtggcaagtctccaaatttaaatgacttccccccgttggatgaatccatggagtactttggggtacaattgtagctcacagaaggcgagggcgggaagatttttaaattctttttggcagcgggtaagaaacctgataagaagggtaattcttatttgagaaattgatgaaattggtggatgaatgttcctctcctttcacatatgagaacctgagctgccagctgaaaatgaggaccacatgttcattattgtttgtatataatcaaattttatccattttg

SEQ ID NO: 17270 - DNA, 765 bp, Picea sitchensis
  Predicted polypeptide sequence is orthologous to G872
ttttttttttttttttgatcatatgcatataatgcaaaaaattattttgtatcttccaaattttagtaaaccctacacaacactgagaaattgaaaaattattctgacgaaagggtccagcaacaaccctgaaaaaggggttttggccagggatattcctttcctccgagtccttgtaagtaattcaaacgtctccgaagttccacaactctgtcgattcgaggaagatgtaggggtacccttcctgcgcaagaatatagagctccaacgccgccgacacctcgtcaattgacgggattttctccaaattcaggccgccattctcgtcaaacggagactcccacaaccccaagttctgcgcctcggaaatctgttgactgtcacatgatacctccgtttctgaaaccgaagacggtcgtgatggcgatgccggcttctccctcgccttattactgttctttttgatattctgcagggagggagaagtcgaagggatgtcgtacaaggcatatttgacggcggcatgctgaatttgctgacgggaaagagaagacgcagacggtatgtcgggcagagaattggggaaattgagtttggcggtgggtcctcccagacaataccttgcgacgtcgtaggcacgggcagcctgctcggcggttttgtatgagcccagccatatcttctctctggatccaggaatccgaatttcagtcacccacttcccccattttctcattcggattcctttaaattggcggcaatttt

SEQ ID NO: 17271 - DNA, 664 bp, Picea sitchensis
  Predicted polypeptide sequence is orthologous to G872
ttttttttttttttttttctataaatttaaacttaaccaatcaaagtataacgtttaaacttcactttatcaatataccaatataagcaaatctacatgctaaaaacgcgtgtcaattttaagccgtattgaagcttaaagagttgtcatcctacactactcctgcaaaaacagttttggctggaccaggaagaggtcgcacgttcgaaactgagcccacgtggtttcccaccatcacactacaaaacgcaaatttgtctgcgtcttcatcccacaaactcaaacgtcacggaaattccacagatctgtggagatgcacgagcgggcacagaatctggaaagttgaatttggtgttgggcagagaatctggaaagttgaatttggcgttgggccccctcagacaatacattgcggcgtcatatgcacgagcggcctgctcaggggttttgtatgaccccaaccatatcttctgtcgagatctcggcatccggatttcggatacccatatcccccattttcgcggtcggatccccttaaattgacgggaaccgcgatcttcgtgtggtggagcaattgtctggtcatgttcctgctgggggcatatctccatatttggcgacacagaagctctaattctaacaatatctcagtgtggtaatcacc

SEQ ID NO: 17272 - DNA, 747 bp, Picea sitchensis
  Predicted polypeptide sequence is orthologous to G872
ttttttttttttttttttggatacattcgcatcaatttatcaatctcataaatttctcaaataagaatagaggttcgttcatgggacaatctcccgcaaccaaaaaaatttaaaaagtatttgccgggcccagccttccgtgagctacaaatgaaccccaaagtactccagggaggaaaatcatttatattcagagacttgccactctccagacattcaagcagtaccgaatcccaaaatgccgaacccttttccgcccaaattttttgcccgtcgttgctgcattccgcttctgaaccggaaccggaggacgagaacgctgcgtcctcttccgaaggcagccggaagtcttctgaggcgaacttggcggcgaaggcttgaatttgcggcggggatagagaagaggcgcaggggatttccggcggggtgtggggaaaattgagtttggccttcgatcctctcaggcaacatacggcaaagtcgtaggcgtgggcagccttttccggagtgtcgtaggagcctagccaaagtctgcccatggatttgggcatccgaatttccgacacccatttcccccattttctcattcggattcctttgaactgccgcgacttcaatgagcggtttttgggtttgctgtggctgctctgattttgggagggtttagccatgtcggggtattcgggaattgcagtaagtgctggtgaagtttgaagtacttaaaacgaaaggagggagtgtgattgt

SEQ ID NO: 17273 - DNA, 278 bp, Picea sitchensis
  Predicted polypeptide sequence is orthologous to G877
ttttttttttttttttttttaaaaaaaacagcgaacgtataaaatttgggatttcctcttcaaattttcatgcccctgaaataatataagctatattatgggtacagattaaaacgaaattgaatagcaatacactaaaaatgggatgccctaccccacaaaatgcccctttgaacctgaaaattacaaaaatggggtcctccctgtcggaaggggggaaacgggggggttattgatgaaaactggaatcaatcgacgggcacttttcctttcatgcc

SEQ ID NO: 17274 - DNA, 811 bp, Picea sitchensis
  Predicted polypeptide sequence is orthologous to G896
ttttttttttttttttcccataattcttaaatcctctatcacaaataaaccaaataaaatggtttttcctcatattaaaaatcctccatcgcaaataaaatggcttctcaatcacaaataaaatggcttctcattgatatcaaatggataagaagatgacaattgtggttcctgtattttcccttgtttttggctgccaccttcataaagcatatttgtaagaacggtgggatttttaggcttttggcgtgctgcacgaacactatcacgcatataacttaacagagtcccataagtttttccttctcccttttcaacagcttttataaaactaaatgtcatggctcctgttgattgaatctttgaaagggccttagtgtctgcagaggtttggtcatcttcacatccactaaaggagatggcttcacctccacttgttgctttacagacaccgttttgaggtgtatggtcctcccacgcacaattcccctgcctggggttgaagacacagaggtagggcaaatctagaacagtgccactatggcaggcgtcgatgattgcatgcaatcgagctccgggaggaagaggtcttaccagcgtctcgttgatctcattgtccacaatcatccccgccgtctcaaagtcgacgggcaaaagcgtttcgtcgtacccatctacttcttcaccactgtaatcttcttcttgctgagagccgtgcccagaataatgaaataccaaagagtcccccgctcggcaatcctgaaccaaccaacgcatccacctctgcatattttgtcttgtggggattctt

SEQ ID NO: 17275 - DNA, 823 bp, Picea sitchensis
  Predicted polypeptide sequence is orthologous to G896
ttttttttttttttttcttataacattctacttgtattatgaaaaacaatacaccttcattaacatatcttcttacataataagtaaaattgaagactaaatagtttttctataattgaacactaaatacatttttaataaaaacctcgacatcaaatataatattatttatcaacttttttaatctctttataactctataagaatacacacacaatgtattctatgctagtattttgaggaaatttaatattttacaaatcttccatcacaaataaaatggcttctcattgatatcaaatggaaaagaagatgacaattgtggttcctggaatttcccttgtttatagttgccaccttcaaaaagcatatttgtaagattaggttttctaggttggatttttccttgtttatagccgccaccttcgatatgcatatttttttgaagactaaaaggtttacgaacagcatcactcatagaccttaacaaactcccatacgttttcccttctcccttctcaatcgcctttataaaactgaaagtcatggctcctgttgatgtaatctttgaaagagccttagtatctgcagaggtttgatcatcatcacagccactaaaagatatggcttcgcctcccatcgttcctttccacataccattttgaggtgtatgatcttcccacgcacattttcctttggtggggttgaagacgcagacgtagggcaaatcgagaacagtgccgctatggcaagcatcgatgattgcatgcagtcgagctccgggaggaaggggttttaccagcgtatcgttcatctcattgtc

SEQ ID NO: 17276 - DNA, 403 bp, Picea sitchensis
  Predicted polypeptide sequence is orthologous to G912
ttttttttttttttttttcagccaaaaaatccaaaactttgtgctttcaaagattgaaatgtctccgttgttacaatgacaaagaataacatgaatctatggtagttttacacaaactatgagaggtttctctttcaagaatccgaccaaagaaatccttcatccaaattgtactcctcatctacctctctctcaggaatagtgaacagagggggaggaagcagaagggcttctgccaaattcgtaaaaaaattgaagtcttcgaacaagtcgtcctccatcgctacacactcaccaacacgttctgttggtctacaaactgatgaggaattactagtatctgttttccctgatacctcggcacttgctggatctgagacggagctaaatactgtacatagtc

SEQ ID NO: 17277 - DNA, 848 bp, Picea sitchensis
  Predicted polypeptide sequence is orthologous to G929, G2344
ttttttttttttttttgagataaatagatttaatttcagatgtatgccgaaccctgccctttccttgaaaaatatcttgtcaaggaagttgcatgccaggatattgcatgcttcagaccaacctttctttggtgaacatcttataaaacaaaatcataaactatatgcatagatattttttacaaaagtcaataaacttacttttttgtttgtccataaacttggagattgaacaggacatacatgttgatgcccccatctgaaatgatgtcattaggttgctactgctgtatggtggcctccactggaaaccatgcctccaacttggccactttctgcattgctgactgaaagaggatgaaatgcagatgaatgaaatcctcgcctttgatgataagtgtaatgcaatccatttgacacactttcacccactccaacttgaccaggagagactgttccagaatgaggagcactgatgccattgccaatttgtgctaaattacctatgcgttgaatcccgttcacttcatgtgaggtaccatctttccctgaatcaggatttagcaccttattactttgacccatagaatcatgagaatcattatcccccgacacatctttctcgttgcttccatcatttttggtgttaagaaaccgaccaccacaaccccttgctcgtcttaaagcatggcggtgtcgagattcatgaagatatggctttctagactttatcagcttgttctcagactctgcttttgcccgagattgtcgtcgtcgcaaaattccacgatattgttttgcatttacatacactggaggttcctcgaccatgtctgatggtggtaacg

SEQ ID NO: 17278 - DNA, 880 bp, Picea sitchensis
  Predicted polypeptide sequence is orthologous to G938
ttttttttttttttttctgataaaatctacattatcctggagagctgaaactccctcatttgaaatacctatattgaaatggtcaaattcttgtggtttgcattcctgtacctcagaatttaagagatccaagtcttgtggtttgcaatcttgcacatcattatttgtataaatggaattcggatcatcctcaaagccttcaacatcatactcgctgctgctgctgaacgtcatagacccagcatgcgtactctccgcagcactgattggtggacaagcattagggtttttctggcgagccaatgcctcctcttggttaacaactgccagccaagttgcactttctttagctgtcatcttatcctgcaagcactttgactgcctaacaagcttgcgaattttggctatatcaggtgacatgtgcttgatgacagcagtaagaacccccaccttccaagcctttttcagatcatgaggctttttgtaaggcggaggcccttgtccttttggcaaacctaattgtggccaccagtcctcattagtagttggccaccaaggaggagaaatacccttttctaaaggatatctccgctgaggaggatcacaatgctgcatgagggctgaaagaagggaacccaatgtggtatcctgaagttcctgaagagtatgaggggtaggagccacgaccatgttactctcatttgctccaggtgttgcatgttctgcttgatatttggcaattgcagcagggccgttcctgtcaaatctgaccttctctttccaccatgctctaagattgtcagaggctccacttacaggcttccctttttcaggaatgatgccgtatacaaaaccttgtgctttgcaaacttccatcatt

SEQ ID NO: 17279 - DNA, 678 bp, Picea sitchensis
  Predicted polypeptide sequence is orthologous to G956
ttttttttttttttttttattttattgtgtataactatatacacaaacgtagttgtacatttctcacagattgacacatcttgacatgtacaacactgttttgatggcgtgtacaacaccacagagttcccgtctaggaacaggatctccaaaagaatacgttacagagaatatgaaagacatttattcacatggattacaaacaaacacaatttatacaaatacatctggagttgatacatacagacagccatgagcaggcacccaaggaacctataatacctttgctcacataccaagaagaaagaaaaccgtcctaatctattcatccctgctcctctgcatcacactgtcacagcgaacttggtaatggatcaccacaagcggaaacatgtgatcaagatttatcacatcctctcctgtccatagcctccttgttttaaactgctagttcaaagatctccatttttttcgtgattgtttcttcaagggattaatgcttggaaaaaagatgaacagtgaacactatccaaacaaaaaaactttgctcaaaccatatctcagttccaattttcaggcaagaataagtagcgaaaccttgaatcaaatggtgctatggcataactccgagagccaaggaaccgttgccttctctgtgtaatgcaattttgcaccaca

SEQ ID NO: 17280 - DNA, 334 bp, Picea sitchensis
  Predicted polypeptide sequence is orthologous to G988
ttttttttttttttttttaagagaaattacaagacagaattagtgatcacctttccaaggtggtcaccaaacaaatgtctctaaccacttcctgcatattcacagtaaacctgtgtaagaagttcctgcttgagcttcatttctcagcaacaacccccctgagattagcattttgagtgccgcaacattagagtcctttgatcttttcttgcacaatcacgtggcatcttgtgattggttagagggtccatgtgtctacaccgtaggtgtccacatcattttccacgaaggctgccaactactatgtcacaaggcacctcctcctttcttctat

SEQ ID NO: 17281 - DNA, 559 bp, Picea sitchensis
  Predicted polypeptide sequence is orthologous to G1007
ttttttttttttttttttgattattagtgtgtcctagaagcaagaacgtgaccaacttcaatcttagattcgaagatagattggaaggccctactagctttgttccatggaagtgtccattgcaaatgctcttggagaaccacgaactttaggatcttgtatagaaggtcatcacacctcccacaaatgttgcttgttggcagagcataacaagaagatgaccaaggtgaagcaagtcatccttgactcagtgaaggatcacctgatccctcacatctccaacaagaagaaaggtaaggagatgttttatgttgtagtcactctatatcaaagtgggaacaagagtccaaagattctcttaacaaatcaactcagagcaacctttttgggtgtcaaatggtatgtggatagtggagcttttgaacatatgacctctaacaagaaggccttcaacaaacttcaagagcaagaggtacgcatacaagtgaagcttaatgatgatgccacatatctagtagcaagagtgggatctatctcattccaatgtcatcaagtgatc

SEQ ID NO: 17282 - DNA, 877 bp, Picea sitchensis
  Predicted polypeptide sequence is orthologous to G1033
gctcttcacattccttgccggtcatccatcttgttcatttctacttccgccgctcctcttcgcttccctcgtctcgtgtgttccttgcgttgtgtcgtgtaatgtttgctgttgtttcatatcatcgcataaaatagtggtgggatttcccttcactgcacacagatttttttttaaagagaagcagacacaggagggggaggtgcaaagttggtttgcatccaatttccagaacgatgaaggatgcaaaggctaagaggactgcagcaaaggacactaagaataaaaatgctgaagccaagaagaagcttctcagtgccaaagagaagccaaacaagaggcaggccaaacccaaagcagtaaaggatccaaaccaacctaagaggccaccaactgctttttttgtatatctggaggagttccgtaaaacattcaaacaaaagcatcccgatgtcaaaggagttacagcagttggaaaagcttgtggtgacaaatggaaagaaatgagcgaagctgaaaaggctccataccttgctaaagctgcacagaagcgagctgaatatgatgtaaccatgacagcatacaagaagaaacaggaagtgggtgtccaaagtgccacacccgaggaatctgaaaaatcaaagtctgagctcaatgaagatgacgaggacgatgaaagtggggaggacgatgatgaataaccgccgaacacgtaagcagcactaaattttccgtgggggatgatggtcttcaagctctgacgagagttttgttatagtttgagatcagaagatttaccagcagaattatacccaatgtttaattgctcattttgtatagcagctgatatcaagaagtttgttgagctcattttgtt

SEQ ID NO: 17283 - DNA, 878 bp, Picea sitchensis
  Predicted polypeptide sequence is orthologous to G1033
ttttttttttttttttgccacaaactcccatgtaatattacataattactcaaaatattacataaatgataaaaacatccaacaatcatttgccatgcactttagatgacggtttagatgataaaataaaattccagaaggcctacctctggtcatttccatttatgtgcattgtcaacccatagttcacatacaaagcgggacatggcagacccgacaccccgtgccacatcaatacatattagtctcatgttaccactcccccaattacgcatgcttcaaaagattagatacctcatagcatttggctaaacccccccacacatgcacagaggcatccgttacaatattatgcccatgaaaccccacaaaattgttctcttaattaaacaaatccagcaatttctggacacacctactcctcttcagcctcaccatcgccattagaattagcctcttcatcattaacatcaccatcagcatcagattttgctacctcgtcctcaccaccatcactggatttagctgcctcatccttgagatcttgttggtatttagacatggctttctcatactctgcctttagttcagcagccttttccaggtatggcttcttgtcctcgtctgacatagccttccatttcaagcccccttccttgccaacctgggcagcacccttgacgtcaggattagtctccttataggtcttcctaaaatcatccatgaaaacaaaaaatgctgtagcaggcttcttcggctgattaggatccctagctttcttctccctcgtgcgctttttcggcttctcatctgcagactttttctttgcctttttcgcttcgggtggcttctgggcatctgcgtgtttggtttctttg

SEQ ID NO: 17284 - DNA, 890 bp, Picea sitchensis
  Predicted polypeptide sequence is orthologous to G1033
tgatagaggaaaatagcaaagcgagatttgtgtagctgcgtttcgactctgttacagacgaacgttcgaggttccaagcccacgcgttgctaaagcaagtgctttcttcgatgaagggaggcaaagcaaaaaacgaggcgtctagtacgctgaagaaagtcgaggagaagcctattgggaagcgaaagactgcagcaaaggaatcgaaggtaagtagtaggcaggagaaaaaagggcgcaaggcggccaaggatcccaacaagccaaagagacctgcgagtgccttctttgtatttatggaggacttcaggaaaacttacaaggaaaagaatcctaatgtcaagtctgtatccgttgttggcaaagctggaggcgacaaatggaaatcaatgtcagaagcggataaggccccatatgttgccaaggctggcaaaaggaaaaccgagtatgaaaagaacatggcagcatacaacaacaaacaaactagcactgcaggtgacagtgctgaagagtcagacaaatctaagtctgaggtaaatgacgaggatgacgaagaaagtggagaggatgatgatgcagagtaaatttctcaaaggcttcgcctgaaatggctttgtatcagtgccattaagttggaagaatttgtaacttgactaattagctgctggtagatgattttgttatttcctaccttttgtagggggcatatatgaaggagatttgatcgctggaagtgtatgcctcgggtagttccatatgtgtagttattcatgaacatgttattgactgctgtgatcatgttattaatgtttttaaaaacatggtcaggtaatcgtagataagatgttttattatacaactttcagttggttattaaaaaaaaaaaaaaa

SEQ ID NO: 17285 - DNA, 492 bp, Picea sitchensis
  Predicted polypeptide sequence is orthologous to G1049
ttttttttttttttttttgctccctaaaaatcatctttcatatgatcagaaacatccaaatgaccatctgcattatgactaagttacaaaggatgagaagatcatcatttactacaatgcacaccatttgaaatatttcatggaaaattcaacatggtaaaatctgtttcatttcaaatcaataaagcctaaaatttgcttaacctttcttttatattcctaaagcataccactgatttctacatactccataattacttggaacgcgaatcttcacttccttccccatatgaaacaaggttcccatttcctgttgctgctctgcttccatatctctacttgctaaccgaaactgcttgggactgctgccccctggagtaatgtcctgctttgtgcttatcactataaccaatgccacgattgtcaatacgcaagctctcatatgatcttgacactaaatatcttctgctccttgaaagtgatcgacccctc

SEQ ID NO: 17286 - DNA, 893 bp, Picea sitchensis
  Predicted polypeptide sequence is orthologous to G1049
tttttttttttttttataaatgttgacttaacatttaatgattaatattcttctttactgtcattaactacctgagcaacaaaaaccacatcaaaacctgcaagagcttatgaattaagctttagcataaaactgaaaatgtctcttcgtcttagaagtggcatagcatcatcgactcatgtgaccatattctaccacaacttaacctcaacataacttgatacagtagcggttttctaccaatatacttatatcgtcctttgctactgtgctatcattttctcctaaataaagctcaccgggaaagagtaaattagatatacaatgggatgaaggcgttctgtgtccctcacatccagaagaacaaattgattttgacatttagaaaactgtggatatgggatctttacttcaacattgggactcaacagtcctcagtcttctgctcactgagatgccgtgatggcttgctgcaactggtgaagccgttgggacaattccagcgtctcggttttcaagaggctattctcttccaaaacttgtctgtaacgctgagtgagtatgtcgaaactgctgagtatttgcctgttctcagctctcatgtgcgccacctgagcgcggagctcgtccaggtgcttctgttttctcatgcgggaccgtcgagccgattcccggttggataacatcctcctttctctccgctcgtcatttattatatgttgctgctcttccaattcgtccgacgcagaattgcaggcagtttggcagctcgaggcggcggaatcttgacgaatgtaacaccccttcggcaggggtttgcaggcctccgggctgctgctgctgttgctgttgttgttactgagagttggaggaggatacaacatgaaaatacc

SEQ ID NO: 17287 - DNA, 796 bp, Picea sitchensis
  Predicted polypeptide sequence is orthologous to G1089
aagacctcttttttttttttttttgtgatgcaatctttttctgatactcaattttcataagctcacctgccttcacttcatcataaagtttattttcccatgctaatagtttgtccaatacagaggcatgggtctccttctccttgccctgcatatcatcattcccatcttctaagccatgtgggcctttaaatgacctattccatgttataacgcgcattacctgttctgaatgattaattgtacctttattatcggcgaaattggagtgatagtgcaaccggttcgcttcgagcatcttggagaccgcaaggccgctctcggaagccacgaggaactgatcatcgatatcctgtaacacctgcagcagatgcttcccactgcctctacctccaactctgttcggggccacggacagctgcatgtcgttgcccgccttctcggcgatcttgttgtccaccacgagagcagacttttccagttccttgatcggatgcttgttgtaagagtcactgtcggtgtcggtgtcggtggcggcctcgtcgtggctgaggctgttttgctggtcctggtcctggtcggggggctccggttcgtccactgagggtcggtgttcgtagtagttattggtattattatagtcaaagaattcccaactactctgctgcgtgggaggcggaggcggcggggcgtcgttggagggcggaggcggaggcggaggtggatgcggcgaaataacggcctcggacacctcgaccgcatgctcctcctcgtcgtcttcttcgtcttcttctcc

SEQ ID NO: 17288 - DNA, 801 bp, Picea sitchensis
  Predicted polypeptide sequence is orthologous to G1145
ttttttttttttttttcctgtaagacactgcaatcagcctatatataacaaaagagtttgggattaatgtacattgtagcaaccagagcctcccagtcaaattccagcattaatcgaagaacagaggctttctaaacataagtgaagattcagaagctatattttgtcacataattgccattctgatcttcgagccaatggtgcacatgactacaatctctgtacaaggctcaagatccatgttcacaagctgcttttgggtcataaaatcatcattcagtgcatcatgcatgccatatacacatgctgccacttttcagagacaaaaatatatacaatcatcaaatagatgccttgtagagaataccaaactgactacacaacttcaaaatggggcagtcatagtccttcgaagcggatgttttgtttgtccaggttgtattgaatgcagcaggtctgcagctgcctgctccttcctcagcctggcgttttcttctataagcttattcacttcaatctccagctcatttgtgtaggcctgtctccttgctcttgaacgagctgcagattctcgattcttgatcatacgcttctggcgccgctccacggtatgatctgctatagactcgcaccctcgtttcttccagacagggtgttcagagcccgaagatgcggccatgagagggatatcattattactgtttgcctgagccgataattccccaaattgttggtgctggttgtgaaattgcagccattccggatgctgcaggttttgacctgcaagcacagaatccattg

SEQ ID NO: 17289 - DNA, 283 bp, Picea sitchensis
  Predicted polypeptide sequence is orthologous to G1190
ttttttttttttttttttgtgacggttggatggcaccgcaactgttattggatgaacaaaaataagcaatggctagaatggctaagagctcgaggagagaagaacacgtacacacgcaagggcacaacgacggatggatgtgttggatgggatggcatcccacatgcaatcgggaacgcgttacaaagtgcccacccacccacgcccacacaacgcaattacactcgacacaccacggactgaatactgcagctaatatttacaagagtgagcatgattacgc

SEQ ID NO: 17290 - DNA, 287 bp, Picea sitchensis
  Predicted polypeptide sequence is orthologous to G1206
tcgaagttttttttttttttttttccagacgccagagatagccatttcgcgagcattggtttaagagaagtccactactcattatgaacctcaatgtcgcctccaaaaacccatcggcatgtgttgcttggccgtgtaatctttggtgcgagagcgtactcggtacgccatcgctcccattttcacgcgtagaacttcttcagcaccttctcgacctctgcgtattcctccttcaccgcaaccagcgtgtccttgattcgttccaagcatttgtcctcatctggctc

SEQ ID NO: 17291 - DNA, 135 bp, Picea sitchensis
  Predicted polypeptide sequence is orthologous to G1228
ttttttttttttttttttacatttcatagtttaaaccattggttaatggagtacagttcgatatgtcaattgtacatttaaatgtcacaaccatgggccaatgccaaatggactacagttttaagaagttaatgc

SEQ ID NO: 17292 - DNA, 259 bp, Picea sitchensis
  Predicted polypeptide sequence is orthologous to G1246
ttttttttttttttttttcgaacgaatagtaaccaacgaatctttctgataattaataataaaagaaatggtagtcaacaatttgcaaacaaaaactctatctccggaaccccgaagaaacccgctgcttctgcttctgtttttttatttttcttttttccttcacaatacccaaacccaaaaactcctgctctgcctctgtataataccaatcagcctacaacaagctcaccacgccaatattttttaacttatgacc

SEQ ID NO: 17293 - DNA, 857 bp, Picea sitchensis
  Predicted polypeptide sequence is orthologous to G1327
cactgcaaaagctactcaatctacttatattggaagtgagggtacttattcatctgctgtttctgatttaggaaaaggaggtaagctgccgcaacaatccattaacggagctgttcacattaatcaacccttgcaacttccatactgttacgctactcaggaattgagcttagaaggccatgattggtctccgtatttgagaacaaacacactgacaagtagctttttcatggcaccctcatcagggctagacagcgcccaacatttctcagatcaaggttatcagacaacagctagaaatgctttgagaggtggacatcaatacgaaagtttttcaacgaatcccatgcaacaccgtgcagtcactgaagaaacccatcaagaaagctacaaggaaaacgatggtgcaaattcctgtactcttcaagccaacataaatccactgggcgcgaccaccgaagattgtaattcagatatattctcttattttctggagtcctttatgactgaggatcagttgctggaagaagcgaattacaagcacgcaacaccagcttcagcttccgtgtcgcaacatatgcagcagctctcgcaggctcaagctcccaatcatgagtacgacatgtggtctgtaatgtccccaacatcacagtatccttcgaattaattacctcaaagataagaagaacgaacctttggctattttcagtgcttctgtttaatctgtattgtctttgctttctatatgaatctgtaatatccttttgtcgatgtcttatttaagagtacatgtatgttgttgtagtaaaacgcttgtgagaaatacaattgctatatattctattaaaaaaaaaaaa

SEQ ID NO: 17294 - DNA, 832 bp, Picea sitchensis
  Predicted polypeptide sequence is orthologous to G1332
tttttttttttttttcttttttctttaataaaaataataatttttatataaaaaatataaacattttacatcgaagagattgatgagatcgtcaaaacggacaatgataggcatttacagtatagaacatacaaaatgtggacgggtatttcctgattataaccgactggcttatgaacaaaagcggcttcttcaacctcattgtaaatgctatttgcagaggaaataataatagcagtggaggaagaagagataatgagatcatcataacagacaacaatcacattttcagtatcaaacatataagaatgtggacgggcatttcctgattagaaccgactgccttatgaacaaaagcggtaagggattcgacaacttcatctccaccgatacagtacctgaatctgaacaagggcttggattttgtttcgtagaagatattagggttttgcccttcttcatagaattggaagatgtcgatcccttcttcagctcctcgtaatacagcaagcaataacttcgtctctttcacccaactggttgggtagcttcgtgcctttcacccaactggttgggatttagtggtcgagtcatacttacagccgtattacgctctgtcggtctaacgaacttcaatctgccaatgcacgcattggcatgagttttcttgctcaaacgagtattcaagcagttcttgataccgttatcggtaccctcaattagtgaccaccagttttccagcagtttatgaagtcttattataagctcttctccagcaagtgaaatggtagcacgattgaggtttggacgaagataagtcacccaacgaagc

SEQ ID NO: 17295 - DNA, 647 bp, Picea sitchensis
  Predicted polypeptide sequence is orthologous to G1380
ttttttttttttttttttctctaaaatggctcaaaacttttagataatgatacgatgtcaaactgtacatgaaatcgaatgaatactcagagaaaggactcaaaattggcttggttgagtatacagggcacaggctaagaccaagcagtgcgtacgtttcatttagagaaaagttgttactcctccctcatgcctcccgaaatttacaaatttgtcggacaagttattcgacatcgttagaggccgggggcagattaagatccagcaaaaagggcaccttccgccgtgaggagctacagatctctgcatcatcctgctgctgcgaattacgagatatcatgagatcgataccgaacaaaagcttcctttttttattggggaccgtttgactcttcgccgctagatttcgcgaggccgatccgctggaaacgcaactagaagcgcctctatcgttgtcggtaggtgaacgcgagacagaagaagcgcaagagattgaaactatggctggatcttgattcgaatagaaatatggccgtagcggccattgatcttgtatttgaacggaggcggcgctggtgaggctattgctcaacaggacggcactgcggctgctcagcgtcgccagcgcggcgctgcggctgctcttg

SEQ ID NO: 17296 - DNA, 834 bp, Picea sitchensis
  Predicted polypeptide sequence is orthologous to G1380
gggcggtgtacctgtatctttgactgttctcgttgggttttgcgtttgttcggcatcttttaatttttcgtggtggccactggcaaaggctagatcgagcgaaacgttagatctctgtgtttgtttgtggatcagagtgacctctgagaaccatggccgtggacaccatgcatatggcgagaatcggtgtgaaaatggagataggagggggcgaggaaacggcgtcgtcccctgtgaagggaacgcatttcaggggcgtgaggaaaaggccatgggggagattcgctgcggaaatcagagacccctggaagaagactagactctggctcggcacttttgacacagccgaagaggccgcccgcgcctacgataatgctgccagaaatctccgcggccccaaggctaaaactaatttcgctttccacgacgataccgccgcactgttcagtaatgacgtcacacgcgccgtccctgctcagcgacaagaatggccgccgcgatcggccttctgttccaagcaagagcccggtgtaatttcgaacatttatgctccttctcccgctcttccttccgttgccggcaacgatcgagcttccagttgcgttatggcggtggagaatcgggcggcctccgccaaaaaacagaagcttctgttcggcattcatctctttgaatcatctcgtaatttacagcagcaggaggatgcagtgatctgtagctcttcacggcggcagccgcccttcttgctggatcttaatcttcccccggccgctaacgatgtcgactaactcatctgacaaatttgtaaatctcacaagactgaaagctagggtt

SEQ ID NO: 17297 - DNA, 711 bp, Picea sitchensis
  Predicted polypeptide sequence is orthologous to G1380
ttttttttttttttttttgctgaaaacttttagtataaatgggatgcaaatttgtacacgaaatgaagtaaaaagggcaaaagtcccttgccttgttacacgggtaaagacaaagcagtgcctgtgtctcgggcggctaatttagagaaaggttgttcctactcctagccctcctgccttctgaaattttacaaattgtcggatgagttagtcgacatcgttagccgctgggggcagattaagatccagcaacaagggcgcctgccgccgtgaagatctacaggtcactgcatcctctcgcagctgcgaaatatgagatgattcaaagagatgagtgccgaacaaaagcttctgctttttggttgggggtgtctgattctccactgccagacttggcgaggcgccgcaactggaaactcgatcattgtcgagacgggaagcaagagcagtaggagccgcgcacgagtttgaacttacgcagggctcttgtttggaatggaaaaccggccactcttgtcgctgaacattgatggcgcgtgtgacaccattgttaaacaggatagcactgttggtgctatcgccttggagagcgaaattggttttagccttggggccgcggagatttctggcagcattatcgtaggcgcgggcggcctcctcggcagtgtcaaaagtgcccaaccagagtcgggttttcttccaggggtctcc

SEQ ID NO: 17298 - DNA, 558 bp, Picea sitchensis
  Predicted polypeptide sequence is orthologous to G1435, G2741
ggtcagcagcagcaacgtccaggggtcgagcctccgaaaaggatcgaattggaggaggaggagtcatcagtgggaggtgtgacagagaacgtgggagaggagccagctcggacgctgaaacggccccgattggtctggacccctcagctccacaagcgattcgtggacgccgtcgcccacctgggcatcaagaacgccgtccccaagaccataatgcagctgatgaacgtggagggcctcacccgcgagaacgtagccagtcacctccagaaatacaggctttacttgaagcgaatgcagggcttgtcctccgagggtccctcttcatgcgaccagctcttcgcctccacacccgttccacccagtcatttcctgcacagggacgacatggtggtgcccctcgttcccatgggtatgggtgttccaggattgggccacggtcatatggtgcccgggccaccgcactacgggggttttgatcccaggtatcttactactctctccaggcagcaacagcagccgccccctccacagagactgggcccttctgctgcaact

SEQ ID NO: 17299 - DNA, 940 bp, Picea sitchensis
  Predicted polypeptide sequence is orthologous to G1444
ggattttgcattggggagagagagagagagagcgagcgcgctttggggagttttatcgctgccctgcgaagcctccgtgggatggggattaccagtctaatgtgcccgtgacctcggctggggaagactgagctaaataaatacatacagagatgaggatccggaatcgttccggtgccttgtacacatctacttcctgtattgccattaacaatggccatggcaatggcgaggagaaggagtttcttcttccactggtagcagctgtcatggacgtccagcaggctgaggacaaagagagtgaaggagatcatgggacttatacgcgtcctgcccataactggaggaactctttgcacctccaacgcagcggcgaagggaagactgaaagtcgggttcttgaggacggcggggagggaaagaaagcagactgcagatggaaggagagtatgagaaatgaatgggataacatcgacatcggactctttacaaagaaaggaactcaagaagccctcctcaaggaaagcacttcaagcagcgccgagaaagagatgatcggaggccgcgatgaggaacggaagttgccaaaatcaggtggccttgaaatgggaactttgtgggggcagcagaaatacctaagtgtgcacggcatccagcggaaaagaagcaaaaatgtgattgggcatattaacgaatggaagcatgaaacaaatatcactaaaaaaatgaggctggagactgatatccagcaggaagatgggcgaaaagtggatgagaaagcgatgcctgttaagcgttataatagtagtaacgaagcagaaggtttctcatgcaggcggaggaatggacgagggtggcggtgttctcagcggactcttgtagggtattctctgtgcgaataccatctgggcaagggcaggcttaggactataaacaacaa

SEQ ID NO: 17300 - DNA, 612 bp, Picea sitchensis
  Predicted polypeptide sequence is orthologous to G1446
ttttttttttttttttttgggctaataacgataagtagggttttgggtatattggcttaaggattggggcaaatacctagtggtttaaggaaaacacatgatttttttggggttagcttcagctatgatcagacacagattttggatttttttagatatcaatgagataaactggttttggagtatgatattaaattgagatttttttagatatcaatgagataaactgattttggagtatgatattaaattgtttttgattagttgagatttcgccttcacaacaaaaagaaaataacaatttaagagtttaatggtccaaaattcagaggcatcatccgataatagcagagctctgccccataaaaaaaaaccaattttatgagaccaaatttcatttacacacaatgaaaagcaactgtacaacgaaatcttgagagtgtcttaatagaaattagatcactacccctgagtgagttacgtgggatttttttacttcaaagaaaaagagtaaaaacacaaaataaacgcttaaaacaaatcattcccaaaaagttaaaatcatggaaaatattcaaagaaactgtacaaaatacagagagaagtgttcac

SEQ ID NO: 17301 - DNA, 575 bp, Picea sitchensis
  Predicted polypeptide sequence is orthologous to G1462, G1463
ttttttttttttttttttaagaaacttgattgctattagtttctagaacttcacagcatatgacagtggatttcctcaaaaccttgctgctttaaagcaattgtcgcattctgcatacgacttataattctacatatgatactgcaacttcaaacggaaccgcagctcttgttcaatagaaattacagctggcatcaaagccatattttaacttttacacacgtattcaataaaaaagaatttatattttaagcctctatggatcaaattctgaagaaatgggctaaaacaacttccggtagaaagctacttgagacggtgatcgatcactataatggaaattttgatcttcggcatttctatggccccgttatttaaagaaatgcaccaaatatctacaaggatggcattccagaactatagaactcatattatggaaaaagggtcgttttgcaaccctcatcatccagaggccatcatttgcgagttaccaggagttacatttttaatgaaaaactcctcgagtttgtctcaagcaaacagagattttttcctcaagctgagctatttcgcta

SEQ ID NO: 17302 - DNA, 507 bp, Picea sitchensis
  Predicted polypeptide sequence is orthologous to G1476
ttttttttttttttttttggtcgtagagatgttactgttctacttgagggatatagctactttatatacatctgagtgtaggagctagagtagctcccgcttctaggccgactatgacgtactgatcccacagatccactggtccacccactggatcttcaacactcccccatcagtgcggtatagtcagtagtaactgactcccctagcttccttgtccacttccttcaagagctagtaacaatacgctcaatcgcttcctcgatctctggatgcgtgtcaaggcagttgaaatctcccgttacgatctgggcgatcctagcttgttctgaagctatagagccagcagagtcagacgagtagtctacttctgctgtagctgtagcagtagtctctttgcctttgttcctagctcccctatgctccttatccttgtccttgctctcaatagctttgaagtcgaagaataagcttccggatatgtctcttataagggcattggtgtgc

SEQ ID NO: 17303 - DNA, 862 bp, Picea sitchensis
  Predicted polypeptide sequence is orthologous to G1480
ttttttttttttttttcagattaaaatttcattaaattacagggaaaatagactttaagtaatcacatggtacaaattttacaaaccagactaggccggtaattagtgcaaaaattacgtggcaataaactggggacaataatctttacaagtgaatcagatacctgccttccgccacatgcaaccctagagtcaacacgtcacagaccactagacaaatccctcgggcggtgttttcacatttaaaacgacgggacgaggccgtagctgagctcggccgacgtgtacatctgagccacgtcagcatcgacccgcttggcaaagcgccctttgatccgcggcctggtctctgcataagccttccttgaagcatacctgatcgtcttctcgaacttccggttctttcttttctccttatatctcagaaccctagcttcgcggtccagctggacgtactggatgcccacgttcacaacgcctgggtttgccagctcgaacacccctctgttaagaggcctcggcatgtcgcttagcgtggcgtcaggaaccacaccgacatccagcgaggacgaagagacgctgtggctgagggacgtggtagtggtatagctgtaagtgaccttctcggtgtcaaagcaatccgagggtgtcgacaccgcgccgtcctggctgctcacgttgctctgcaccggcacaacgctgtcggtcccgccggtggcctccagcggcgaggcgtagtcgagatccagatagggatccacgtcggggaacaaatctacgacgctgaaatagccccccgctgccttgttaacgggaggacccgcgtcgacgccgaagcagcttcccccgtcgtcgcagttct

SEQ ID NO: 17304 - DNA, 850 bp, Picea sitchensis
  Predicted polypeptide sequence is orthologous to G1488
ttttttttttttttttccaaacattcggcttacataaataagagaaatatcatacatgaaaaatataaagaaaattagtaaccgggacgtccagagatcgaaacccgaagaatataaaaaggcaattagatggtcagttcgaagattttttcgtgataatcaacctgcataacagttttaaagaatgagaaatacgttatgcagaacatcacatgttaccgcataggtttctcagaaacaaaaattcaaaacctaaatttatacagagtacagttgagaatggtcagacacaaaggaatggaattgtgcccaccatgatgtcgagtcttcagtaataattaaaggtaaaatactgcattaaatggtgtgctagctgtagtatgtcatcgaattatctgtcaggcttgaagtttcctgctgtgagagcggctgttgttggtctatcctctgccgcctgatttcgactactcttctgtggcaattcgaatggagcccgctggagaaagtggggctcaacgcgggtctgtactcgggcaggagcctgccggatttgaacctcacaccgcaagcgttgcaaagcgtcttggggcccagcgggcctgttctccactgcggggttttctgtactaaacaatggctgcacctccggctctcctgcccgccgccgcttctactttggcagcccttcttcgccttcttgaccgcggccggtggcgccacgcaaaccgaccccttcatcgccgccttgcgtccggttcggggctcgtcgttcttgagagcaacgctcacgaaaacggcagggttgacgcagcgtgacctcttactccgggcacgccccagcacccacgtc

SEQ ID NO: 17305 - DNA, 826 bp, Picea sitchensis
  Predicted polypeptide sequence is orthologous to G1493
ttttttttttttttttccaattaccatctgttccttcattcactgaggaagcataatcaacatcatcagatccttttctgtgcctgtcattgtcttcaaaactaccagaaggatcaaaatcttttggctcattccttttctttctaatcacatgctgccatatgttcttaagctcctctaggcgtacaggttttatcaagtaatcacaagccccatgcttgattcctttcataactgtacttgttcctccgtctgctgacatcatgatgacaggcaagtccatttccagtccaacatgctcaaggagcttgaagccatccatatctggcatataaacatcacttatgactagatcaaacgcacctttcttctctcgaagcattgataatgcagctgtagcacgacaacatgttgtaacttggtagaggcacctcctgagcattttatcaaggatcttcaggcatgtggggtcgtcatcaaccactagtactctgagtcctgcagggaactgatgatctgctttcccacctccatagctgttgcccgtgctcatgctcatgctgctggtcacagagtcgtgtgcaggcatcatcaccattcccctcgtcctgctccttcacacccaccctcctcgcatgcctgacttccggaggaggaggatctgtctgtgtatctatctagcaaagtactggagttatggccaaccagccatacatacataccactggtaggggtaggtactgcctggctgctatatccttcctctgactgactgcaatgaatggatcgctggtaatcaacaacagcagcaaccgggggggggggg

SEQ ID NO: 17306 - DNA, 382 bp, Picea sitchensis
  Predicted polypeptide sequence is orthologous to G1499
ttttttttttttttttttctcaaaaaactttgaattaataaaatctttgcctacaatgtttcaccaaatttaaattttattttgaaatctttatcaaactcccagttaaaccacagccgaactgatacggatcatcataagcataatgttgacagaacaagacaacatatgcagtcttcagattgcatttaattctgttcttacacaaaccataccccatcatctcattgcatttaattctgttcttacacaaaccataccccatcatctcattgcattgaattcggatcacttttttttcgggagtgaactaattgtcaaagtatgatcactcaccgactcaattaacacagaacgcccaatttttatattacatctcatc

SEQ ID NO: 17307 - DNA, 679 bp, Picea sitchensis
  Predicted polypeptide sequence is orthologous to G1638
ttttttttttttttttttaacaaaatctaacacagatttttctatcacatctgtaagtactataattcttaaagagaacagaacttatcaaactcacagtctccaagagcagagcagtaaactaaagctttttccagcaatgcaaatatttcatgctgtaacaatacatataagtctctaataaatggaagtgatattactgatcagaacaaagattctcttcaaacttcctttggagtagagaagaaaaatacctgtgctcttcttcagtccagggaacacctttctttctctcctgttcagatggcttggttgatgatcccctcccaccactcccaaattgttgcttcagaccatgcatgtcgcctgattttccttctatccattcaagtgtacaggaagagttactgtaagtgggtagggcaacacagccagcttcaatacaagtaacatcatccacgagatcttcataatgctttctaacatccgtagcagtttttccaggaagcctggccgccactttatcccatctatctggggtgtctttgtcaaagtcagctagagtattttcaaaacgtttgttctgttcaagagtccaaactgaaccagatgaactcaaacttgtcccttgggagggtaaatccatctcccacatcgcacaaatcttaaaatcccttct

SEQ ID NO: 17308 - DNA, 885 bp, Picea sitchensis
  Predicted polypeptide sequence is orthologous to G1706
ttttttttttttttttttgtgataagacaatttcattatgagatcatagatattctgtgtacaatttttgtgggatttcagcccagggatatatttacatcaatcattttggcctgaaaaaaaacctccagggatggaggatcaaggaaaaacaggcaccgaaaacagggaaagagacgactccatttttcaggatttgcgtctcggaggaacatgaacttgtaatgtcgcgatttgtcttattttgcttgtgatgtgtggaggccaattacagtggctctgcacaaagggcatgaagagttattcacagtacatggaagaagccagctatcaatgcaagaaatatgaaaataatgtctgcagttgggaagaatgcggactccatcctcctccccaatacaccccaaacagattgcacatgatgataaaggcgaatcattcctatttgcttcatctgatcttctcaaacacccgtacttgcctttgggcagcgctccgatcatcttggagcggcacgacagagtgctcatcttgtttggattaggtctggagcgattgctattaacattgatattaatatgaatcctgcccagcagtatgaagaatcccacaagcagggcaagcacaccgttgaaaagctgcaatgcagggagaacatgctcattcaaaccctccatcacatgtatggcgacctccaagacacgagtccccgctgccaaatccaagaaacgcatggcaatccacaagaaaaatcctgcagccgtgcaaagcccatagattgcaatcgacgccaacgcggggttgaatttggaaaaacgcgcggacgccattcagcatacgctctgttaaacgctcgaacttgtctctcgcagaatccaaaaaatg

SEQ ID NO: 17309 - DNA, 706 bp, Picea sitchensis
  Predicted polypeptide sequence is orthologous to G1743
ttttttttttttttttactattaaattaaattgataaaaaacaaacaatatcattctcacattgttaatatgcatactttaaatactctcttcatttttaagtaaattcttggaattggaaaagtgactttagggcatttgctacgcctatttattacacctacatatcccaacagactactttatggtggagtaaatccttgggtgcattgatataaacgaaaattattacacaacttctcgttttcaatacaaacacagcacgtcgacatggactgtgaacctaccttcttcatcgctgttcttcaatctgtgattaaaggagatctacagagagggcagctcttctgttggacatccagccatttcgtcaaacaagtttcatggtaaacgtgacagcacttagtgagcagcaggaccttctcatccatcgcaaactcgctcaagcaaacagcacagacaccgtcgttgcttttaagctcatctcccagatcctcttgtatcacaccaaacgtttccagccgaagcactcggcgctgttcctcgtcaacagggcttgacattgtgtcattatctgcccacacaacttcagcaggttcctccaaaaacccaaaaacgcggtggatcgactgctttacatatcccattgaaaaggcagcatgcagcaaaagcttaggccgggggggggggagattaatttaattaa

SEQ ID NO: 17310 - DNA, 164 bp, Picea sitchensis
  Predicted polypeptide sequence is orthologous to G1804
ttttttttttttttttcgtgttctcttcttttagttgatttacttcagcttccagctctaccgtataagcctgttttcgagcccgagacctagcagctgactctctgttttttatcattcgcctcggacgcctttctacaactttctcaaccggtccatccaag

SEQ ID NO: 17311 - DNA, 587 bp, Picea sitchensis
  Predicted polypeptide sequence is orthologous to G1839
ttttttttttttttttttcttaataaagagcataaagagcacagcaagtagcagtgctgattattaatttcaataccataattaacctggaagaatgaagaggaaccaagtgaaataaccagtatctacaaggggtttgtccttcaaaattaaaagcctcaagacctttccagggcccaggctgttgttggattctcattcccaggagaagagtctatcagcgattcatcagaaacaagaggtaacccaagttaggttaagccatagcaagctatttggcccacacagaatccccatgtgagaaattagacatagtctgaggaaacaaacctcgttttatcgagcacacaaccactgtaatccaccatccatatcaattgcgagattcgtcccgggctgaccaaagttctgcagcagctttatgactaatacatttacgcaatcccttaatgttaatggccattgaggcagaaaccaataaaccctagctttcatctatcctcggctccaggatgaatccccttgctcgatgggaattttttctgccctcatctggactctgcggaacgaccatcttgcctttgctt

SEQ ID NO: 17312 - DNA, 651 bp, Picea sitchensis
  Predicted polypeptide sequence is orthologous to G1863
ttttttttttttttttttgagatatcggaggttgtttgattatttacaccgggtgtgagaaagcagtcgaacgagaaacaataaaaccgccaatacccataacgtcaacgcgctcaacacgagactctgatttttgtttaaacgcttgatgtaagactagggagccctggagaagaaagaacaatctgaaaaagtactccagctaaggcgaaaaccaactttttttgtttccttttgtcgtaacattcatgccatgtcgttggccgatcgttcaatcttggagtatccatccgaggattcttccaagggagcaaaaaaccaagtctccaggttccgggaagcattcgcaaagtaaggctccacatactccgcccaaagatgcgatacaccgagtaaaagacaaacaaaaaaaggaagaatgcaagcgataacgaagttgtttggcattggtagcgtctcgatggtgtagggattgccgtcctcgccaatcaactcttccttgaccggagtcattgttccgaatagcatccaagccaacacagtccgtatgagggccccgtggagaaggtaaagcgggaggctcagattccccagccaaccaagtgtagggtgagacaggattctcgagagaattggtgagaatagtatacc

SEQ ID NO: 17313 - DNA, 576 bp, Picea sitchensis
  Predicted polypeptide sequence is orthologous to G1893
ttttttttttttttttttattgacgcactttcatcaagctgagaatataaccctttcactgcgatcaaagatctcacattgtccgagggagctcatgcttcacagctctcacagaagaagaatagtacgtgcacataatataacataaacagctgtactgattcccactgccagtgtgcatcctcccctgctacatagaaaaccgttctttacagtgttgcactacacagctaagagtgtaagtaaaggtagtcagcaagcacgtgtttctagaaaaagaagaaacaacaatcaatgaagaagctttgctggataattcttacagcagatcttgggtatatagaatcaatgagacaagacagagacttcgtcctcagagcccaaatcctcctcgtcttcgaaagaatctggggcgatgggggcatgtccttgcccgaatgcccttatatgatctttgagggaacgcttgtgcttgaaatctgagccacagctgcaataccagagcttcccacagttcttctcatgggtgcgccagtcgcccctgacagcaaaggttttgttgcacttgcagcacat

SEQ ID NO: 17314 - DNA, 774 bp, Picea sitchensis
  Predicted polypeptide sequence is orthologous to G1932
ttttttttttttttttaggaaaatcgctgaaaccttttaaatctaaatatggtgtaaaactgtacatgaaataaaatgaatggtcggaaacaaacactaaatctgcctcggattggatacaaacagcatagacaaagttgtgcctacgtctcagatcggaaaagttgttccgatccttcttgccttgtgaaaattacaagttcgtcagatatgtaagtcgaaatcgcttgcggccgggggcagattaaggtccagccacaagggcgccggccgtgccggtgagcgacagatctcttcattctgctgctgctgtaaattgcgagatggtaccgagagatgcgtaccgaacaaaggtttcttttttttgttggagaccgtctgagtctccactggcggatttagcaaggagtccccgatgctaacacaagtaaaagcccgaagattgtcggaaggggacggaagaacggcaacgcccggctcttgcttggaataaaaaacaggcctcggcagacagtcttgtttctgagcagaggcggcgcgggcgacgccgttgttgaacagggcgttactgtcgtggagtggggaggggccgaaattagtcttcgccttggcaccgcggagatttcgggcagcattatcgtaggctcgagcggcttcttccgcggtgtcaaaagtgccgagccagactctggtcttcttcaagggatctctaatctccgcggcgaatcttccccacggccttttccttacgcctctgaaatgcgtttccttgac

SEQ ID NO: 17315 - DNA, 848 bp, Picea sitchensis
  Predicted polypeptide sequence is orthologous to G1950
ttttttttttttttttgggaaaaatcgtctcatacagtttcgtaaatccttaaaaaataagaatcaaaagacagatcttaagaattccagcgaggccttttaaataatgccgaatttctatgcatggaaaaagtaattcactcagaaattatgccgaaactagaggaatatataatcgattgtgtacaaaagaatttacctgagcaagattacatagggtcttaaatgtattgaaagacgtaacaaagtattataacatcaaagtctttagctgctctctataagcacctcttctcaactgttagctcaaaatgcctcattattgttgtaacatcccatctttgaggcctgatggcatgttttagctaaaaagcataaatactatcagtcatcaagcatgactttggcagcatcaattagtgttctcctaaaatcccctgaagctcgaccaaggactgtataaccttcattgtcttcacaatcgacatctgcaccatgccttactaaaagtaaagcaatctgcttgtcattgctgattactgcattcataagaggtgtttgacctgttttgtcagtggcatcaacatctgcaccttcctctatcaacagttcacatatttctgggtgccctgcacttgctgcccgatgcaatggagtgcaaccaaacttgtcctttttcctgatgttggcaccattggagattaaatcttgggcaatcttaacccgccctttactggcagcataatgcaaggctgtacgcccaccattgttttgcacagaaacatctgcacctgcttgcaataatgcttccacaacgttagcatgcccactgctcacagcagaatgga

SEQ ID NO: 17316 - DNA, 820 bp, Picea sitchensis
  Predicted polypeptide sequence is orthologous to G1954
ttttttttttttttttggagaatctcataaccatgtattgtataaaagcaataggctttgcagtggatggagtacgccattgagttacgagtttacaggatattagcctcaaagaatagggtagggcacgtacaaacagatattctacgtttactctttctcagagtggtcatgatggtcatgtacactagaagcaaatcatgcacatagattcaggatgcactgaattaaccagaaggatggagatagtacaattcgaagcttgatcggcttttaattgtgtttgcagtagcgtccattacctggaagaagagaatgatcactgtactaacccatcgcactccctcattctgcaattgaaataaatatgatggagaaaatctgtactggagacctaaaatgagtatgaagtgcaagcatggagacattttttactaagcggtcacgtttagttgatggcgttggaatggatgctattgatgatttcgtgcactgctgttgcaatttcgtcagcggacgttaactggcactcatcttcaatcttgacattgaaagagtagagaacagtctgatcgatagtggtgatattgaggtgtagaatcgtcatatgaagactttgaagtttatcaatggttttcataagctgtccagacctcttttgtgataggattttaatactagcgtgtgtttcaatcatagtcacctctatatctgccactgcagacttattctctgcaatcaattcgttgcccgtatcgttgaaggaagtcttttcaacagcatatctcgagttccattgcgcggagtatgatgtatactg

SEQ ID NO: 17317 - DNA, 627 bp, Picea sitchensis
  Predicted polypeptide sequence is orthologous to G2035
ttttttttttttttttttgaaaataagagttttgagatttctgtactggtagagaaaagttatcagagtgcttcggaaaatccagtgatcttatttcttttttcttcctcgacgtcgacgtttcgaatcacaaaaactaatctttccccaaaatcgtacaggtctcttatggatgtgtggtgaatgtgagagcggcagccaggaaggcgatgcccgcgcatcccatggctatatacgtcactcttctacacaccacaaccatcgtcagatcttctgatctcctctgcaacaacaacgcaaccacgcccataccagagaaaaacgtggccgcgtccatgaccacgaaaactcgaaactgaaagctgtccatggccgcttctgcggcggcgtggcccatctctttctccagccccatcggcacgctgaacattgccaggaaactcaaagcggccaccgtcatggccgccactataatcacaccaccgcctcccttctcctcaatctccccgccctctgaaagaagtaactgctcttccacgtctttggaaacgccgggactctcgagcggatgaaaatccatgtgaaccattcagacaaacaaaaaaatcagacgaagccgagccgagc

SEQ ID NO: 17318 - DNA, 545 bp, Picea sitchensis
  Predicted polypeptide sequence is orthologous to G2057
ttttttttttttttttttgttgcataactctttgttcattctaagcagcgtacatcgaggttccaccctaagctcagcccatttatcgcgatacctccagatgatcgactccagtacaccaacttactccatataccaagccttctcttccgtcctctatgatttctctgcccaccaatccataactggccaaacagcaacgggccagaacatcaccacagcagtgactggaacaaacatcatcatagtccctccaaaacgtttcagcggggagtcccaagtgggagatgctgcgctcttcccggtgacagtggagtacgtccttcctctgatctgttgcatggcgccattttggagtcttgtacgtgcaagcgcagtgaggattcgtgattgaggggccatttccggtggtgttggagtttgagatgaagtgcggggtaaaggggagagagatagtattcgagtacgaggggattatatgcggaggctgtgggattactgcttgcagttgctggttatagcgaggctcaaggaatgggatttga

SEQ ID NO: 17319 - DNA, 438 bp, Picea sitchensis
  Predicted polypeptide sequence is orthologous to G2057
ttttttttttttttttttcttttttttttttttttttaattaataataacattttatttgttaaacattgttataagttacgaaggaggttgtgtatgtatgtaatatgtgtaagaagaatattaaagatcagaaacttcacgtgaaagacgaaagccttgtttttcaagatcttgttgagtgagtctgactcctgctctccatttctttgttgtgcttcgtgtagtaggtggaggatgaggatgaggatgagaatgtaataatgatccttgagattgttgtgttgttgttgaagttattgttttatatcgttgttggtcattaatattattagaagaagaatttatttcaacaactcttgcacttcgttttgttggtcgccttttaccccctaatttatataacatatccaactttgaataatcatgtggattaaac

SEQ ID NO: 17320 - DNA, 550 bp, Picea sitchensis
  Predicted polypeptide sequence is orthologous to G2109
ggtccgatgttttattgatatccgaatccctcgccctcttactcgatgaattacgcggggagggttggagttattccttcctgtccgtttgtttcaccatttgttcgatgccggtgagatctccagcacgatttactgtctttgaagagctggggacgagatgggtaggatgaagctcgcaatcagaagactggaacacaacaacaacaggcagattactttctccaagcgaaggaatggcattatcaagaaggccaaggaactggcaatactttgcgacatagacattttgctcatgatgttttcaccctctggaaagcccacagtctgtgtcggagaaaagagcgtaatggaagatgtaattgcaaagttttgtgagttgactccacaagagaggtgtaaaaggaaactcgaaagccttgaagtactaaagaaaacatttaagaggttggaccatgatgtcaacatcgacgattttttaggagaaagatgtagcccagaaaaaacttagagaagctagaggttcaggagcttcataatgagttgacaa

SEQ ID NO: 17321 - DNA, 499 bp, Picea sitchensis
  Predicted polypeptide sequence is orthologous to G2140, G2765
ttttttttttttttttttgcgtctcgttacagtttctattttcttatacactaaggaaaatattcttcgatgaatatacatgaaaacaaacgcactagccttgctacgaaattcacaagtacacaccagcaaatgctgttttgcatgctcattctggccgtccaacaaaaccaaaactctgttgcttacagatagatattttatggaactagtaaaggtaaagaaaagactcagatggacctgccgtcatgaatatgatgaatggagctgaaaggattgagacgttgccgtttgtttgcggtcgtggatccttcagaattttgcctttccattacagctttgagagcgtcgtggacgcagctgatggatggaggaccgtagtcggtgttatcttcctttgatgaatcgatcagtaattcgtgcttgaccctgccccctagggtcgtgatttcggctttgatcgtgcaaagtcctagagtgccgagggtctttatgaggc

SEQ ID NO: 17322 - DNA, 924 bp, Picea sitchensis
  Predicted polypeptide sequence is orthologous to G2141
ttttttttttttttttatagtcaaaagtattgatgacttagcaccatttccaaattagagaaaaaactgcggttccatctagaagggaggccccgaatctatttgtagatgggatgaaaactgcaaagaatttgagagactcagataaccgggaattcatgacatatatacactcctggtaggtaggttaagtagtagcatgtatgttactatgtatgctgcaactgcaaccaaacattgataaaagtaacacagtcaaactgtgataagtttttgcagtggaggagatcagtgtcagtgtattgagtattagagtggtcgctgctggtgctgatgctgctgcagtctgctttgcagcaaccccatgttatacatattctgcagctcgctgtcccaaccttcctgcctctgaaaatttgtaccatcaaacatttctgcagagtctactgaactcatagtggaaggtatatccgatccgggacttggtactgtctgcagagaagcctgcttcagctggtccaagtggaagtatgttggagacattcccttgcttgagaagcttccagacatctctttggcaaagaaattgtcgatgttaaagtcaagctttggattgactgtagccaatttcatggacaagaactctacttggtgttgaagagattgaacatagttgatgatctcgtcaagcattactgctttaccagtgaccttgttgcaggtaggtaccaggtcctgcaagaatttcattctttgattgatcttttctcttctcaccctttcagctaagctatggctgtcagtagcctggcctctccgtgccctaacatgaatataattatcgtccttctgagagacatttgaattcttctccttccccttctttgagttggagtccgaggtctcgtcattattgtcatcgtc

SEQ ID NO: 17323 - DNA, 766 bp, Picea sitchensis
  Predicted polypeptide sequence is orthologous to G2146
ttttttttttttttttccaaacagaaacccaaagaaactgaaatttcatattcaaatttcatagatatgcctgtacacagaaacctaaagaacaatgccaaatttattgacagtttcagtttatcttctagatggaaggaaaattatattgacagtttctctgccagatggaagactgaagatacatagacttatatcatggaattaatattggaagaatacgatcaaagacatatacgatatacagagggctgctcacttagcgaacgaaataaaacctaatttcatgatccgaattccctggcctgcgtattccagatcaggtggagcatatctttagaagcgctccaccctcgacacggtgtaatattttatgttgttaacatatccacattatagtatatactaccagctgctgcgtgcaaaatgcctgtcacccgtgcttgtccagcccggggttcgaccttgcggcatatacatagacctggcaagcagcataagtaccctaatttgtgtaccagcctgtgagcgcctgcatggcctggacctgcatcttgagcgccacgatgtagtccgtgacctcttccaagaaaacgggcgtgtccagccggcggcatcccggaatgagctccctgagtgtctgcaaacgagaagccaccgagcctgtttctgagcggatgctagtccccgacctggacgccactccgaacagccgcctgatggacttcttcccggaaaagatcgttttgcaaggcctgctattctt

SEQ ID NO: 17324 - DNA, 378 bp, Picea sitchensis
  Predicted polypeptide sequence is orthologous to G2157
ttttttttttttttttttcgatccgctgttctcgctgttctcgtcttcagatgtatgaaagtcactggttagcatcccgtgggcgtggccattccccggaccgggaacaggagcatacacatctccgaggcctgagcgggtccccggaacgactcccgccatcgccacattgcccgcccaccaccgggttgccaggactgcgtcgttagattccctacaccaaaatctctctaaccttcgtcgaccttgacataaaatttcaaactccctgccttctatcacgcctcgctagctctagctcttctccgactctgatcgatcaacccaatccaatcggccgcgggttcgattctgacagagcataaagccggttcagag

SEQ ID NO: 17325 - DNA, 534 bp, Picea sitchensis
  misc_feature (503)..(503): n is a, c, g, or t
  Predicted polypeptide sequence is orthologous to G2192
agaaaatgttgatatctttgctccctttacaaagtcaagtgcaaggggaaactcatttgtctggtctacgtagttcaaacctgggctttaccatctatatagagcaccttttactgaactgaagtgcaaggggaaacccatttgtcctgtctagatagttcatacctgggctttaccatccacattaaacttgtaaacatgagatcacagaaaacacgggaaattcaatccaaacgcttctgctcctgatgtcttgaataatagtcctgatcattggagtaatttatgtcagctgcaggccactggtgcatggtgaagatgtgtatcactcatctttcattagcaatcagcatataagtgagtaccattttacaggataactatttctctattgattaaaagaatcagaaagcattcatgcttttgtattgtgcagcacttgccttattcttctgtttctatgatctgtatttagtaagtctataactttaaagttaaataanaaaaaaaaaagaaaaaaaaaaaaaaaaaacc

SEQ ID NO: 17326 - DNA, 329 bp, Picea sitchensis
  Predicted polypeptide sequence is orthologous to G2192
ttttttttttttttttttacagggcaataaacatctagattatagcaagagcttcccaaaggcaaaagcaattaacaaaagcttgtctgcaaaacttcataatttgaaaggccaactgaaaagattgactcaaatttatgaaaacattcgccgagaggattggaggatcttctgagtcacagttctccagaactttcacatgagcttcctacatttgaagacatatcataaactacaagtttaattgcttttccgccggataaatttaagatgccaatgcactcttgcaaatccgcatcacatgctagtaaaacccactcatgatcatc

SEQ ID NO: 17327 - DNA, 812 bp, Picea sitchensis
  Predicted polypeptide sequence is orthologous to G2226
ggtgttcatttttctcacttctctctttgttcatgcagatctggttggttgtgccttgtgtcacagaaaatcctaatgggtctctcaagctttcccaccactgtctccgaaggagtcctgccaattctgattgtgaatactgctctgtcttttgccattatcaaggacatcctgaggtcttttcttcagattgtaggccttaccacaggcactgaacctgattttatcgacccatcatggccttacccacctgaaaatacccctgcagtcagtactggccattccgaagcgcagttcattgcagaggaaatcaggcagagcctacccatcaaaaggttccaatcttttactgatgggtttgttggtagtgacaatagccatgttgagtgtgcagtctgtttatccaaatttgaggaaggggttgagatcagacagctgacttgctgccacctttttcacagaccttgccttgataaatggctggaccatcagcagatcacctgtcccttgtgtagatcatgtctgatatccgaagaagcagccaagaatatcaggctcagggaacaggagcttacagatgaatcggtattttggtgttcatccttccaagaagctgcttatcatcatacatggattgaaagttagagttgcttggatcctgctttgatggatccttcaacacttcatccagttatctgggtctataattggagattctgtaatcttttattgtaaatcatctttaggaaaagtgcttatttctacaggatgctttgttgcttctcctattgaaagcaatcctgttttctgaa

SEQ ID NO: 17328 - DNA, 903 bp, Picea sitchensis
  misc_feature (819)..(819): n is a, c, g, or t
  Predicted polypeptide sequence is orthologous to G2239
tccccgaccgtctgagagtttcaattttgtcaggattggctattgcccgggatagggatgaagagcagacgattagcgccgctgaatagttcgaatgatggaggttctgatttgttcctcacaggaaactctgggaatctgagtttctcctcgccattttctgccatgggtttgagcgataacagaacgggggttaacatcagcagcccatccaataacaaccatgatctcttcggcttcaatggtcattttaatccatccttggcgattatcatcatcgtgctgctgagcgcgcttttcatggtggggtttttctcgatctacttccgccgacgcacagacgaagacgacagcatgaggcgttccagacgaaggccgaggggagtcattccacagggatggtgggaagacgacagtaccggtggtctcgacagagacgtcatcgaaagcttcccggtgttcagctacgatctcgtgaagggccttaaggcgcagaccaaagaaaccctcgagtgccccgtctgtctcagccaattcgaggacgacgagctgctccgcttgctgcccaagtgcagccacgccttccatccggattgcatcgatacgtggctcttctctcacacaacttgcccgatctgccgaatcattctggtgcctacggacgatgagaacccaacgggcaccggctacggaattatcgaacccctcgaggttaccccgccggatgaggtaacggttgtggtagacggaacaagaagcagctggagaaacgggagcgttcgcagggacaacgatatcgacaccaccgttgcttccgangaagccgattctcacgaattgcccggcgatcaggcgacagaattcagtcgctcgcactcgacggggcattccctggtgaggctg

SEQ ID NO: 17329 - DNA, 881 bp, Picea sitchensis
  Predicted polypeptide sequence is orthologous to G2239
tgcgctgtctgtctcaacgaattcgaggacgacgagcagctccgcttgctgcccaagtgcagccacgcttttcatccggaatgcatcgatatgtggctcttctcgcacacaacgtgccccgtctgccgaaccagtctggtgcccacggacgatgcgaaccccacgggcaccgactacggaatcatcgagccccccgagatcacgccaccggacgagataacggttgtggtggacggaacgaggggcagcagcaggagaaacgggagcctgcgcagggacaacgctgtcgagagtcccgcggcttccgagatggccgattctcaagaaccgctccgcgtgatggggcttaatcaggcaaagaaattccgtcgctcgcattcaacggggcattcgctggtgaggctgcccaaggacttagatcaatcggccacggaatggtatattagcacggcagaagggctcaccccgggtctgcacaggaactgtagcctgaccgcgcgccctcactcgcgctctcagagatcgttggcctctaaatcccgccccgctctcgcaaagcaggattccttgagaggcgccgcctctttcagcgaagacgccgggacaagttcgggtactggatcagggctccgttggtatgagcgtggactgagatcagagcgattatccctatcatccatgaatccttcctcgtttctaaggacacattcggagcacagggcgccttcctattccaggtatcaagattcctctgcaggttctcaacaggagcagaaggcatatttgcaatctctgaagagcacactgaagaggctcactggaagagacagagagtggacagataattcgctgagcgggcgaagatcttccaggagggctgc

SEQ ID NO: 17330 - DNA, 865 bp, Picea sitchensis
  Predicted polypeptide sequence is orthologous to G2298
gacgaagatagcgggcaaaagtgccgcccatttaagggaatccgattgcgaaaatgggggagctgggtatcagaaactcgaatgcccagatctcgagagaagttatggctgggctcatactcaagtgcccaacaagccgcccgcgcctacgacgccgccgtgtattgtctgagagggccgaatgctaaattcaacttccccgattctttgcccaacattccgtctgcgtcttctctttcccgtcgccagattcaggtcgccgccgccaaatatgccttcgatcaactcccttcgagtccgtcctctcggcagaatatcaatgataaggcgacggaggaggcagcatcgccgtcaagatcggcttcggtttcagaaacggagttgtcgagcgacagtcatcaaatatccaacgaagaggagttggatttgtgggagtgtctgtttgaggtatcagacagcaatgctcgatgcctcggcctgaatttggagagaatgccatcaattgaggaggtttcggccttggaattttttcacagtacttcgcaagaagagcaggaggaggggcacatgaacatcttaatcgaccccacagagttgtggaacttttgaataattgcttacagtaatgtcgaatatccgctttttgaaatctcaactattggcttgtatgctgctgcagcgtgggggcaagtttcgaactagcgacctctttatggagggcccattccaaaagtattgccgtagttggctgggaatcgggatgacgactgaattacgggaattggaaccattgggttgagtagataacttttatgtatttaatatatcaagatttcaagtctaatctacttacaagattttggat

SEQ ID NO: 17331 - DNA, 516 bp, Picea sitchensis
  Predicted polypeptide sequence is orthologous to G2298
cagtttttgttttttttttttgtaatattctgccgagaaagcgaagttggagggatttcctccaaggcctatttggcggcggccacctgaatttgctgacgggaaagagaagatgcggacggaatggcgggcaccgaatcggggaagttaaattgggcgttggggcctccccggccataccctgcggcgtcctaagcccgggcggcctgctccgcggttttgtatgacccccgccctatcttgtctctggttttgggcctccggatttcagacccccaactcccccattttctcattcgtattcccctaaattggcggcaattttgtccgcgttcttcgtctggtctggaatggtgctctccggaggctttctccatatctagagacgcaatgccaacgctgaatgattggagggaaagcagtgaatcacaatgtacgtatgttgcaatttgtttacgctaaaaggcagagccgtagagcttcgtaattgctgaactgaaaatatcaaatgaaatc

SEQ ID NO: 17332 - DNA, 702 bp, Picea sitchensis
  Predicted polypeptide sequence is orthologous to G2298
ttttttttttttttttttgatcccaaatagtttacacgtatgtattcatgtacatattctttaatgtaataaatatatatacataatacactccactgggtaaacctacctaaaaattggaaaaatattttgacgattgggtcaaagcctgttgcctgcccgacgacgcaaccaaaaaggggttttgcgactggtgggaatttgagaagtggaatgttcgtttcctcttcttccctcaaagtaattgaaatgtctcagaagttccacaaatctgtggggtcggagaaaatgtaatcctcttgctgctgctgctcctcctgccaagttggaatgaactccaacaccgacgcctcctcaatagacgggattttttccaaattcaggccgccattgccgtcaaacggagtctccaacaaccccaagtcctgcgccttggaaatctgccgactgtcatatgaccgcgccgtttctgaaaccagagacaattgtgattgcgatgccggcttctccctcgccttgtgatcattattttttatactctgcagagagtgcgaagtcgaagggattttgtccaaggcatatttggcggcggcaacctgaatttgctgacgggtaagagaagacacggacggaatggaggtcacggaatcgggaaagttgaatttggcgttggggcctctcaggaaatacactgcggcgtcc

SEQ ID NO: 17333 - DNA, 258 bp, Picea sitchensis
  Predicted polypeptide sequence is orthologous to G2343
ttttttttttttttttttagaaatccagaaaacggcaccttctattcaataaattgtctttctagcgcaaataaaacaaccttcaacaagaataaggatggtaatctctaaataaaagaaacaaactaacatatagtataggatgtgctcagacgtagggtgaatattgaattcctgggcacaaaagggcctcagagtgagctgggatcaccaatcatcattgcaaccatcaattggagatatcacggccagttaatc

SEQ ID NO: 17334 - DNA, 614 bp, Picea sitchensis
  Predicted polypeptide sequence is orthologous to G2348
ttttttttttttttttttcacactcaatttttacatattactgattatattcaaacaagtgaacgcttgaaattgaaaacctaccttttcagttgcttccttaagacacagcaaattttcatgtaaatgacactaaagatttggaagatactcgaactcagttaaatgattgaaaagcttgcttccaagccactcctctttttctgtgtttttaacactaaatttcaacagattgactgaatttagggaaataattaaagaccactttccctgctttaaagacacctttaattttcaatttatctgaaattgctcgcactgagcgggatgattgaagaactcacttgccgcattgctgacagtatcgctgaggcacgtcgtccagcacaacggtggccgcattcgcgcaacatagacacacacggtgccgcctgtgatagcccttcaggtgactgatatcggcctcgcagcttggcacctggcaacgcaacacgacaacttttgcccgttttcggctcaattcctcctccatgttatccatttcggggcaagcacacggcacccgccccgctaagaaattcgagcagatgagccgggggtcccgtttgcgaatc

SEQ ID NO: 17335 - DNA, 869 bp, Picea sitchensis
  Predicted polypeptide sequence is orthologous to G2348
ttttttttttttttttagtgaaaataagtaattatttatacaagtaccggaaagcagttacagataaaaatgccagctcagttcatagttattttacattgaacgataaatggtttttattttcagctgatgaagcttgggctgaaataactctttgcttattacgcacccacgctgtctccatggtttgggaggtgcgtaccagccgcttacgaattaataggatacattaaggaaactgcagaacccttgagctgaaagtctctgtagttataaagatacaaactcataaatttgagatggctactaagcagtcttatgcttatttaggggcgtgaaatgtcttcgtgagctttgcgcaagccagacaaacatcgtcttagtgacatggagatctccattacttggtgtgggtgctgaagtaccacacagattccagcacaaacagaaattacagtaattgccaagataaagattcgacgatcgaccctgatatcaccttttaggcaaactttcatctttcgagtgtactcagccacctctatctttggacctctccatgttgagttatacttcatgtcacttgcaatactgctagaacattccttctcaagcaagggcgtgagcatgttattttcctcaactgacaaaacacgtgtatcaatcgattctattccagaggaaggtctggtttcagtttggatctccaatagaggttccatttcctggctttcctgagatactttacggggctgctgattgcaagataaagttgcaattttcattgaagaaggacaaccttgcagtaccacattatccaggaacccactggaatcggtagtaactttataattggggcttcttcctaa

SEQ ID NO: 17336 - DNA, 844 bp, Picea sitchensis
  Predicted polypeptide sequence is orthologous to G2425
ttttttttttttttttattaaaaaaaaatgtatcagtgcacgaccttaataatacttaaactaacatatcttggcatttacaagggttacaaaaatatttctcaagcttaaaatgttattctgtgacgtattcactaaggtcttctttaatatagaacctcgctggaactactttgaagaattttcctgttatattatacacaaattcaccagttttctccataaaaggtcccccaaagaatggagcaaagctttttccattctcgttgagcatccgtactacaacgtcactgacgtcttcgttacccaaaaagatattgtctgcagcaaaaacaagatttcctaaaatttcgaatttagactttatttgaccatcgtctcctgctagatacacctctcccttagcatctttcgtaactttgagtttgaactcaatatgaagacgtattttttcaactttgacttttccaaaaccatcgccacgtacaaagtctcctcccaataagctttttactaaaggactagacgaagtagctttgtaatgtcctttcactgtaatatcacatgtcaagtccatcgatgaaactccgctctcgacatcagttaccatcttatgaattttacaatctttaactcctttagctactccgtcgacaagagtgatatctaataaatcagcaacggacactgacacattcttcagctcaagtggatctatgggaggaatccccaattctttcactcccgtttttcctatgctgcttataactgtttgaagtaattctctctggcactcgttgtctcttacactacattttggtagtgaagacacaaaacttgcgtc

SEQ ID NO: 17337 - DNA, 757 bp, Picea sitchensis
  Predicted polypeptide sequence is orthologous to G2457, G2459
ttttttttttttttttggatcatcaaactgatcattaaagcattttatgaaacatggtgcgtaaactcctatggtagaagaacatttatcatacaatacataatgatatctctctgaaaagatagatcgatcaagataacgtagatataactcgtagtgactagttgttgcatacttccgcgttcagaacatcgcccccatcctctgagttagattgcctgcggttgtccagcatcaacccgaagtgaatatgaggataatgtgcccagttcttggcagcggcgctaaaagcttccttgtgagttatttttggattgttggctttgatcctctggatttcgtctctaatgaaacgattatatgcagatggaacgcgctgtttcttctcgggctgtctgtaagacggaatcctcgtttcttcgttgtccggataagcatcattaatggcagtagaagaagatgccggatctctggtgtagtcgtgcggaccagtattcgggccttgctgctgcgcctgttgtggcagcgactgcaacaagggcgccatgtttaccgacaaaaggttagtgcaatgaccgcatcggactgtaacaatcctgtataagctgttgcatggaacgtttaccgcgaggattgtgctacaaaagtcgcagtgaacgtagcagaggtgatcctgcccgacttcgaatccgctcgtcgacatgtctgaatcacgttttcaagcaatctcccttgccttctcgtcgggggggggggg

SEQ ID NO: 17338 - DNA, 687 bp, Picea sitchensis
  Predicted polypeptide sequence is orthologous to G2457, G2459
ttttttttttttttttttggcctcaagtgccctgtcaacagagctaagtctttattttaaaggcaaacagtgtttaccaaaaaaattatattttaaacacgtggtatgaataactaattgttctcacattacgcatggagaaaatcagaaagcaattgtactgtgttagttccctactaatacccctgcaagagggcttcagatatcattactataaaatgcctccatatgactcatgtgatccagataaatacccattggctcaatttgaagtaccaacaacaaaaacattatgtcgcatcttgaaaagtacttacaaaaataaactactctatgcacaacatgcctcttttgaattggagtcaagatagcatattgactactctgaaatgtacttttccttttcataattctccttttgctgcttgccaggagcggtgatcttgaagtgttctgaaaatgattgaccagggcacagaggtatccatttgagacaatttgtggaagcagttccctatccaagtgctagatataaaatatggacatcttagacttcatactatgaagttgtctcaatctgtattgaagacattctaacccaatgaatacataattattctccaaatgcaccaaggctattgacaaaacagagaccccacctcaaataaatacagtttcatccttagc

SEQ ID NO: 17339 - DNA, 723 bp, Picea sitchensis
  Predicted polypeptide sequence is orthologous to G2510
ttttttttttttttttttgttgaaggattcgaacaagtcctcttctattagacactcacccagacctttcgtgggtgtaaaaaatggcgacaaattagtagaattcgtttgctccgatagatcactacctgactccgactctatgtctgagctaactggcctaaacaattgatctgaagaggaggcggctgcattctcattacttactggagattcttttgggcttctccttgctcgtttattgccatccatcgaaaatctggagctccttgctcttgcagatgcagaagagaacgcaccagctgcttctgcagcggcagcctgaatgtggcgcggagacgaagaaatgggtcgtggaaggtaatcaatgagttctgggaaattaagcatcgcatgcttcttacctttcaagcagtacgcagcgacgtcgtaagctcgagcagccatctctggcgtaccgaaggagccgagccagattcggtttttcttttttggttctcgaatttcagacacccattttccccaactacgacgacgcacgcctctgtactctggatattgcggcttcaacgtgctctcctgttgcggcgaaggggcagacacatctcgagttcgaatcctcttcgtcccacccttagatgtcgatgcagatttgctgcttgattcagtctctgttgatgaagtgagcatggtctcggcgagaaaagaggcttccttatccat

SEQ ID NO: 17340 - DNA, 597 bp, Picea sitchensis
  Predicted polypeptide sequence is orthologous to G2535
ttttttttttttttttttggtttcactgatgtatcgatattgatatacacttgcatttatgcataatgaaatacataattagatagttcgatgacatattttggaggattttccatgcataacatgtcattggcaacggtatggtcaaatgaaggaagaaatataccagtagcacatactgaatcaacaagagttttagttagggtagtatctcgtaacagattacagaacacccaacagaggaagtaatgttagtctcctgttcggcattataaatagaatggtttacaaaggaatgggatgattaacatcccaagaaccgacttcccccacttaaaagcacacccaattcttgttttgaatcaatatggagtccttgctaatgcaaaactgtaccttgcaatgaaaattgctgcagcaatgaatgtgtctctatccaattttgaattctctaacacttgacatttttatagagatgctaccagagagaacaaaatgtggaatcagcaccaaggaatggagaatggtgacatgtgaattgatgcagcagaagagggatctctgaacatgacttattctcaaatcttggaaattacc

SEQ ID NO: 17341 - DNA, 819 bp, Picea sitchensis
  Predicted polypeptide sequence is orthologous to G2565
ttttttttttttttttgctccaaaacgcataaaattgtgaattcagtgacctgcactgctctctattctacttgcaatccagatgcatcctcacggagaccatatccagagtgctgcaatatttgttcactgatgactacagaaggtggtcagcacctcataaaatattcctctgctgagacaaggttgaaatgtatgtctcaaatacagcttcaggcaatggctgattgttcatgataccaagcctgtcgatagaggacctagtttatccatacacgtgttgtcagggtttgatctaatacgttttgccggtggggcttttattccatcttcagcatctggaattgaccctgacccacaaggaggggtcttttcagtgtctgccacaacttctgagttgttgtcagcaaccactaccggcaatgatttgtccctggcacccacagctagaagtgtcccacggccactgttatccttgttttgcactgtctcaattcttttggcaggaaatgatcgagaaccatcctcttcaacatcagaggactgctccaagggacctgcagcagcaaacggattacttgaacgtggggcagagaggctttgactcttgaatgagctatctgttttttgttgctcttcaaacatcttctgtaggtattttccatgttcttctatctttaactgcaatgctctctggacctctagctgctcgtgtagcttcttttgcatctccatctgtaaccgcaatgcctctgtaatttgcatgcccgctttgaggtccagagttggtaaatcatcagaagaattcctcttcttgtc

SEQ ID NO: 17342 - DNA, 799 bp, Picea sitchensis
  Predicted polypeptide sequence is orthologous to G2571
tttttttttttttttaatttgcaaaacttctaaggcattaacagcaagactgtttttactcattcacaacaacagcccagccagaccccttgaaattcaaacttaccagaactgatacatgcattttcagtctgcaatgcacaagttcgagtttgactaccttcagtgccaaggtctgaacagccattaagaacatcccatgtcatgtctgcctccaaaactggcagattgttcaaccaattctcgtcctctccctcctcccatacaaacctttcaacttgggcatttggggattcatggctgctagagctttcgggcatgaattccgctaaactagcgactttgccaactgcgttaccgttatgtgcacttatctgaactgggtcactcttatatacatttatctgaactgggtcaccgttatatgcagttgtccgaactgggtcacccttacatgcattcatatgaactgagccactgttatatgcatatttttgatcagaactttctctataatggcgaggactcatgccactagtggaactgatataagaatcctggcagttttttgagaacaaatggggaaaattaagcctggcgcactcaccccgccattggtaagcagctcggtcatatgccagagccgctgcttctgcagtttcaaaggtgccgagccaaagacgagttcgattgcgggggaggcgaatctcggctacccatttgccccattgccgctgccgaactcctcggtagagttttttcatgggctggcgagctgcaattgcacacttgtctcgct

SEQ ID NO: 17343 - DNA, 825 bp, Picea sitchensis
  Predicted polypeptide sequence is orthologous to G2592, G2713
ttttttttttttttttatagcaatactataaatgatcaaattaattcataaattaaaatacagtccccaaaatcctccaatatacttggttctcattattaattgtgatatcaagtataaaaaaggctttacacgatggaagccttacatacatctccctagacctgaactctgcatcattacagcagaaacatttagtgcaaactacaaaagacatatactagtccacagactttctgaaaacctcctatgacccattattcttaaaactattaatcatatcaaaggaggattaagaaagtttctctaaccgatacccctgcatccctgtctaagcaaaagaagacatgttcagtcaaaataaaaaagatcctcatgacttgaatcatcaatccatgttatacctgcagttaattgcagtgtggatccatctggtataatttttatttctatgttacgaaccttgtgcatgttagacatcatgagaaccaagaataaagaagtaaataccatgcaatatgattattataaaacaaatcagtatgcactattaagcatttgagaccctttaattctttctaggcatattggtcaccacatatgatcaaccagcatcatgatagtccctctattcacaagccaacttagtatcgaaactgctaagacagatggcaaatgcctgaaaagctgacaggggatatcggtaatccatagtgaaaacatcctttccaacctttccaaactggagtataaccttatcctggtcactctgagagacagattgtgcaggctcagtagctgcaacaagctgaaagttctttacag

SEQ ID NO: 17344 - DNA, 880 bp, Picea sitchensis
  Predicted polypeptide sequence is orthologous to G2717
ttttttttttttttttttacttttgcaataatggaatgtatatttgcttgaaaagagacaattgcaacgaaaaaattagaattacaacatatgatgaaggcaagatcctcaggtcccataaccttcgaactgaactatatagctggcataagcacaataatgctacctgcccatcaaattctcttcctggtacaagcacatgcctaggtaaggttcaaacgaaataacctcaatatatgttgcaattgcagatttgtttgatccatttggctccttcaaggtagagactgcatccaaaatgagcttatctaaccttgaaatagatcttttggtatttgagcttggcaaatatggattgacagttgtcaagggcttagtaaccacaacaacatccatatttccattgctcaatgcactaagcgcaagttgcctgccagattgctttgcaatgtatttgcttcttttgagtgccagtcttgccttttcccttgaaccccaaccatttgcagtaacactcatattccgccatttatccttcagatccacattagatcgcgatgccaagcacaagctcaagctgggatctctcagaatagcacgccatttaccaggaccatatttctccaccccagtcctaagggcagcctcctcttcatgcgtccatttctgctttggagcccccatctactgaaaccgtgaaattattttcactgccacaacagagctcctgctgccaaaacctatacgcccgattctacttgcataccatccctctttctgcgtgccgcttagggttatgagagtccgtgcagtggatggatatcgagatgcagatggatatagacgcaattcttgcttctttctttgctattttctattc

SEQ ID NO: 17345 - DNA, 775 bp, Picea sitchensis
  Predicted polypeptide sequence is orthologous to G2790
tttttttttttttttcaacaaacgcatttgctttttctttagtgtttttggcctcgtcacatcattgtcaatacacagccatacacagaaaagtgcaaaatggcgtcaatagataagggcggaaaagcagtatagcatctttgcaggttgcatctgcttttctcagacagacatatacatattttatatatatcacagagaatcataatctaaatgggacatcgaggacgggactgcttttcgtcccgtcctcatctttctgcttttctactattagctttgaatttatgtggtaaaggtgacaactgttccgttgaaaaacgcaggaacagactgaaaagaaaaaccaaaaagaaaggggttgcaggatgtcaaaacttggaaccgcttccgattccagatgtccagaaatctgccccgttgttgttggctacatggagagtacatgatacaggaaccaggcataatcctctgctccggaggtcgtatttcgcctgatctcctcgcccatccttttgattggagggaatgcctttgagataaggtgagctcaatacctgaacctgatcttgtagaaatttaatgtatcccatggcttcaagaagaacggatgccgtatcggtctttccaaacggcgaaacgagctgctgtaacgctgtaatgcgttcgcctagcttctctttgcgcaccttcatcggagcgcccgcagaaacttctgttctaggtttcttgaaagctgtattggaaagccccgcttgatcgctgtttctctttt

SEQ ID NO: 17346 - DNA, 554 bp, Picea sitchensis
  Predicted polypeptide sequence is orthologous to G2865, G2934
ttttttttttttttttgcgtgtttaatacttttatagatatgttttatctacaaaaatggcaaatacaagtaaaacaatcgccccttttcttgtgcttttaatacttttattgacatggctcagatagagaaaacctcaccttccgatattcttcagggagtagcgatatcagtgttaaacaaagcgctttcatcttattccgtctctgcctttccaccagtttgtgaagctgactattcccagtacattccctgctggcctcatgatcatgacctcctcctccggctgccggtttcttccttcgatgggtccgtgccggtgggaaaagagggttgctggaacttggtaaagaatataccggcgagttacaggttagggtttgagctggctcgccaatgccggctacgaagttcttccaacattgcgtgaccgccggtgaatactcatcctcagcagtctgatcaagctgcaccaccagtcctaaagagtctggtccgagcaggccgtaataatcgggccttttggcggagaggctatcaaatattactgctgc

SEQ ID NO: 17347 - DNA, 857 bp, Picea sitchensis
  Predicted polypeptide sequence is orthologous to G2964
ttttttttttttttttggcttcaaatcaaaacgggatgggtaatgtctccatacaaaagaaatacgagattttgagactagaagaaatggcatactaccatacaacatgcgatatctaagttcgtgagtccaatggcatttaacatgacatttcaacatcattctagtcaatgtacagccctctaattcaaaaattgtcaaaaggtttactgaattatcatcaaacagctaaacaaagtctggcagatgagactagaaatgaggattaccgaagttcactggcaccatgtgcaaagtggcaacgatccccaaatgtgcaggtaccctgggaaaaattctcacacacctttgttttgtaattgttgaaaacaaatccagatggttttgcagctacagcgctagtttgcattatcagctcgtgaaccatggtactggctagttttatctgatcaaagctaccttccagctcaatgttctttagattggaatcggattcgtgatctcttatagctagttttgctccagttgcgtgacaaatctgcttggagtttacaccaccttttccaataatggcaccagcaagagaagcatcgacactgatttttgctgttgctgaagcaccaaatgaagctgccgctgccattccaggtggtgtaggctcacgctgcacaagtctacctccaggcctgccatccatcacaccaggaactggcctgccataagagcttaatgtccgttccctctcaacaggagcaagtgtattgcctttcttcagttcattttcactgtgggcaaaatgacacttatctccaaaccggcatccttctgcagtcccatagcgattacaaatccgtgtc

SEQ ID NO: 17348 - DNA, 561 bp, Picea sitchensis
  Predicted polypeptide sequence is orthologous to G2964
ttttttttttttttttttacttgcacaaatctttcagttatacagaattgttttcatcaaataaattgggaaatagtgtggacttcaccctacaacaggccatgcccaagttcaagcaagcccgtagcagtttaaataaacatgaagtaattactaatcctcaccatctacaatccctggctcaaaacttgtgatacagtactttctagaatatacccataaaggaaggaagagaatagaaaatcagatttatttagagttgtctcgcaactcactggcaccgtgtgcaaagtggcaacgatccccaaatgtgcatgtgccttgcgcatagttttcacagagcttggtcttgaaattgtttgtagtaaacgaaggctgctttgcagcaggcagtacagcacttgtgtgcatgatgagctgacgaaccatggcacttgcttcctttatctggtcaaaactaccttccaactcaatattcttcaggttggtatcagactcatgatctcttatagctaattttgcaccagttgcacgagaaatatgtttagagtttataccacc

SEQ ID NO: 17349 - DNA, 769 bp, Picea sitchensis
  Predicted polypeptide sequence is orthologous to G2981, G2982
ttttttttttttttttctcctttgaaattatctccattgccataagtacattcagtgcatcagaaacccttcgccaaatgttcttttcatcatattgttgccggtctggtgaaacaagagtgctatccagatttgcatattcagctacaagttcatctgcaacctcattatatgtggtccgccccttgctctcaaccttctgactgactttcaagctgaactgccacagtcccctcccacccttctccccaccattgactctaggaactctttttctcttccttgtgcctgcagtctctggagaatctaagtcctcttgatgaatatctaaatgctgtacccttgcaatatgattgtttcaggaaggtgttgcaattgctgcatcactgcctcttgatggagagccagcacttccactttccacacaaattgattgccgtggtgcacatgcagaatttcctgaacatctaccagaagttgcatttgaaggatattctccctcccctaactgtggagtggatttattttcctcaaccttcattccattcgtatttgtcccattttgggtaatgccaaagccttcagtatttgtcccattttgggtaatgccaaagccttcaccatatttttggatgctagcttcacggaactcgctaatgatgtctttccgtaaactgttattgttgtgaggagaagttgaaaacactgattgtgctgctgctcttctgttcctgatgccacttctgggtccagttgccctacgggtgga

SEQ ID NO: 17350 - DNA, 785 bp, Picea sitchensis
  Predicted polypeptide sequence is orthologous to G2989, G2990
ttttttttttttttttgaaaagggtaattagcagcccattaaattactcaaggccaaatggcagaaccacagaccatacaggcacagccgacagaaccctaattgaatacaaaagctgcctagaagagggaataaattactttacacttatgatgacttcgatctctgcagtgaaagatctcaacagaagatacccttctcgtgatgaaggattcaggagtgagatccaaaggaaagagatatttttcaattcataaattcaggaaataaaaaggattaagcagaaaacagctgtcccccaaaaccccgaaagaatgcctgaaatccatagaaattcaataaaactcccatgtcggtaacataattttcaagatttcttaccgagagtatgcttgttgttatgcatccagaccttcaaaacacccttcccgacaccaatttcattacaaaactgctgcacaatagcctcatcctgcttctgcatcctccaccccatcttatctgcgaacatatacatcttctccttctgatcctgcgagaacttggtcctgaacctcttcttcatgcctctatgatgatggtggctgaggttattattactgttgttgttggtattgccatctgggtcatcagactcggtgagaccagagcttagcgccatgagcatatggggagccgaggaaccgtggggcaaggggagggggtaataggggacaacgggggaacccggccctgacgaggatgcgccgccacgcttcttgcggaggcagcactcgcaggtgggg

SEQ ID NO: 17351 - DNA, 432 bp, Picea sitchensis
  Predicted polypeptide sequence is orthologous to G2990
ttttttttttttttttttcttcgtttgtgttatttggctattggagaaggaaggaggagggcttgtggtcatcatcactcattgtggagatagctaaacaaccatcatcatcaccatcaaggggtttttagtggagcaaggtttcaatttcatttgccaatcggtgttgagtcttccattcataagtatgtatttaaatcccaccatgttaatgctatttttttcatagatttatgcatgtttgcttgtctctttgcttgcatacatattgcttcttttttttgtcattttgccatgattttcatgcccataaaacaatgtaagggttttttctaaatgggacagcaagcctgagccttgatattaattttttatccaccctcttattgtcgtttttcattgctaataatataatctagaggtttgattttc

SEQ ID NO: 17352 - DNA, 466 bp, Picea sitchensis
  Predicted polypeptide sequence is orthologous to G2994
ttttttttttttttttttgtactgattgacatcaaatttcttgtatagttcaaagtaatttgaagtcaaaacagtttaaaccagcatataacccagaaaacttgaaccaattgaaggaaaaagtgatgttgccctgttcaggtctttggggaaggaaacaacctcgagtcaggaattttctttgcagaagcttctcctgctcagatgctgacagtcttgactcttgtacattgagaatatgatgtgataagcaggaagtaagacatcaactgcatgctaaaacctaaaaagcgcatgaacggctaaaaatattccataaagttcatcaacaaccggaacaccatgctgtgtgtctcaactctcatcaatatgagcagattatgatggagaatgcaccatttatgccagcagcaatatcaacctacaattctaaaatacattgttgtcagggaaaatgcttcagaaa

SEQ ID NO: 17353 - DNA, 628 bp, Picea sitchensis
  Predicted polypeptide sequence is orthologous to G2997
ttttttttttttttttttgtgaagaatattcatggagatttcaccctgcaaacgtatccccttgcacgtccgcaaaccccatcgctctaacgtccctgtcttcaattttgtcttccttctcatagcaccctggtatcatgcaccttggacgccgcctccatctcctccattgtcagatcgccaattttgacccgcttcacgagactgaagtggtgtccgacagggcaccactgaccacgtgtttgacccagccgcaacgccttcagcgagaccttgggaacccaaatggtcgtatacaagtgaccatcactgcagcgaacgatcctgtcgtacttgttgtggtgcttgtggcctgcgggatggggttctgggatgctggcgacggcggggttgaccttctcagcattgagggtgcaggcatcatccgagattgtagacttctcggcctcgtagagagtagaagcagttttcgacccagagccggacattgtgactagagtatggaccggcaacagatgtcgaggttagataatgaggtttattatgttttctggggggtttggagaagttagtttagcggtaggtgcggcttcagctgctctggagtcttgctcaaccctctatctta

SEQ ID NO: 17354 - DNA, 707 bp, Picea sitchensis
  Predicted polypeptide sequence is orthologous to G3000
ttttttttttttttttgcactgtcaattatgatggaaagatatatacagaatatatagtttttttttagggacacaaccaacaattaaaattttccataggacagaaaaatagtaacccttaactatccagccgtttgattaatattataccagacatatagaaacagacaattaggttcacttcgccatagatcggaatggcggattatcacccgcgtatgcgatgagactcgcatagggtcccgtttccaacttccctcctatggaagctgcggtgacaattgcaagctgcacacttcatggcttcagccgttccctcatccccgctagctataaattctgcgcaaccatcgaccgcgtagccgccagtgctggcagcgtgattctttcggcactctctgtagcgcacaccctcccttgatgcagcatctccttctctaacgattgcggctgcgccctcttcgatctgctgcactatttcaaacggccccatttcctctacagttgttatttattgaggatgaatctgtacggatcttgcttcagggaactctgatatcagatgtagaaatagagatctcgattcatctgcggcctggtaatttagctgtctatatctttgaaatcacatagaattgctgacggaaagagcgcagctgcaagtgctccgcatcctaatctgtatcccccaatattcctccggggg

SEQ ID NO: 17355 - DNA, 774 bp, Picea sitchensis
  Predicted polypeptide sequence is orthologous to G3067
ttttttttttttttttcctttgatagcacaactttgtattaatctattagcatttctacaactaattacatatacatcctctgcatattcagcagtcacatttaatcctctattctgtaagagagaatcttcaaactcttgagaacaagaaccagtcacagcattgcagcgagaggctgccagctctatacacccttatcagcttcctaatatctagtcactatgcaaacaagtcataatgcagcacactaaaggtattaatctgcccaaagaattcaaatactctatcaacatccatctcttacaatggaagatttagagtaatgaaagagggcaaacaagaagatcaggctggtggggttgtttacaaaaccacaaacaaatatgacagacaactaaaataagtccaaacacaagatatggaccaatcagtatacgtaaaagttaaaacagtcagcttttttttagatcttatacatcaccacaaaacaaggaagcaccgccttaggattaaacacaaacaactcatccagattagagtagattcctgtctgaccagctaatgaatcatatccaccatttagacactcgtctgggtcttgggacttttaacccgcccagcaataactctgcaaactagcattgctctcttctcctttgattcatcctcctctgatacctcaatggaatcatgggcttttccactgcttgctgttgtgtaaattcctttcccattctcaacttttgaggaaaatccatgtcggataatattgc

SEQ ID NO: 17356 - DNA, 951 bp, Picea sitchensis
  Predicted polypeptide sequence is orthologous to G3067
ttttttttttttttttttgatagcacaactttgtattaatctattagcatttctacaactaattacatatacatcctctgcatattcagcagtcacatttaatcctctattctgtaagagagaatcttcaaactcttgagaacaagaaccagtcacagcattgcagcgagaggctgccagctctatacacccttatcagcttcctaatatctagtcactatgcaaacaagtcataatgcagcacactaaaggtattaatctgcccaaagaattcaaatactctatcaacatccatctcttacaatggaagatttagagtaatgaaagagggcaaacaagaagatcaggctgtggggttgtttacaaaaccacaaacaaatatgacaaacaactaaaataagtccaaacacaagatatggaccaatcagtatacgtaaaagttaaaacagtcagcttttttttagatcttatacatcaccacaaaacaaggaagcaccgccttaggattaaacacaaacaactcatccagattagagtagattcctgtctgaccagctaatgaatcatatccaccatttagacactcgtctgggtcttgggacttgttaacccgcccagcaataactctgcaaactagcattgctctcttctcctttgattcatcctcctctgatacctcaatggaatcatgggcttttccactgcttgctgttgtgtaaattcctttcccattctcaacttttgaggaaaatccatgtcggataatattgcagacgttgcaggatggaaaattacataggttagttaatccatccatgccaagtgaacaagtgaatgtgatggagtggaaacgaagtagttcgttggcatctgctatgcaccttgggtgcttcttggctgacttgttggctttagcctttaccatgtctctgtaatcttcgaatttgttgc

SEQ ID NO: 17357 - DNA, 792 bp, Picea sitchensis
  Predicted polypeptide sequence is orthologous to G3095
ttttttttttttttttgatttcaacggcacatatttaattacagagatcggatggctagttacagagagatcgaaggagggcacttgtttggctgtatctagttccacatccatagcctgtcagtctgtcatttgcagtgcgtgacggcataacaggcctgtccatcatgaaccctgacaggcttatccagtatccggaatacgtataaggaggatatacattgtgtgccaaacttggtggtatatattttatataaatatatatatatatatatatgcacctatacctctccgcataaagttactacaaaaattatgctccttgatccgtactgagctcgcaattaacttccgagtggagcccggtgtggaattcctttccttcgcctggccgtcctgtaatttgttgccataggcggtgtagggggcgacatgtcggtatacccattgctacttggactataacggccgccgaccctggtgccctcgtcgttcatggaatccccagatgtatacgtctccagttcgttttttatgtcggctgcgtttaattcgtcagagaaacggtgggattcgatcttcttcatcagtcgggctcttttgtgggtcgacgagtcttccgattcccatcctctcggatgatgaagaatatgatgcttcggttgcacgaggaacgttgcgtcccgactgttctcgattcctcccaacttgcaaccgagagagcagaagcggaatgtgtcaaggaggctcctgtcgcatatttcgcaggtattggtaacgcccttgcctggc

SEQ ID NO: 17358 - DNA, 828 bp, Picea sitchensis
  Predicted polypeptide sequence is orthologous to G3095
ttttttttttttttttgcataacctaaatcatattacattaaagtttgtacaaagtgttatgacccctccacattcaataatattttacctaataacctaaaaccacctaagggaaaagcacgaagcaatcctaagtttgaaagatttgcagcacatgaaataatcgtactccaccagtctgttagttgcttaaatatattgatattcttcctcgggatgatataattatactttcaaacagaatcttgttattatttatgctcccgagtcctcgcataaacaaaataccaaataatcacttacatatttgttcaagggaaatcctacatcaagagatgccagtctgatggctgaaataatgaagttggaggcaatttcaccgaagcaggagggaaaatcttcaaaacagggcaacaaaagttctgattgagtggcacgtagaaagaggtttaccaaatcttcatgctgttgaagcaagacttactcttaaaactggcttttgtacagtttctgattttactccagcatgagacggcaagatcatttccacatttatagaggactccaattcttcagagccattttgacattttccagctctcaatatacaactgttttgcaatcctttaccagaaccaatctcctctacactttctttctgagtgaaagaccttttttgctccaattggtcaccattcttgacacaacctttgcttggcttctctccaacttccacaggtttggcaatcgcaccatatccagcagttgagctcgaatgatcaggctcttcagcagaacttgtttgagatgctaacccagacctattg

SEQ ID NO: 17359 - DNA, 729 bp, Picea sitchensis
  Predicted polypeptide sequence is orthologous to G3967
ttttttttttttttttctttttttttttttttttttttttttacagcatataaaaaaatatttatttcatcctcgaaactctagaaatacattagctatttcctgagaaacccaggaatgccaagttccatgcgccggggtgatatacactatgacgagaaaaatatgcggtgtcaaacatttgcagagaaacctaatgcattggctgctaatgcaagaagggcaatagacatcccccttgcttgccgattgggggcttcccaagccaggcattgttctacagctttattccaatcttgaacaacgatatcctttccataatacaaatgttcagaatggtggtttttttctgaaaagttcttgcaatacctgaaattgagagattccgcatgcaagatatcccgcaaaactgatgtactaagtgcgcggacatgagcactggaatgtgaaagacattgaacagtagcaggtagccgatacttcaataagttccatagcccttctgccattgccttgcctggaatcccccaacctagtgaaagctgtgctgtcactgccattgcttctaacagctctaattgtggtgttgtacatgcttctccgtcaacaagcatgccatctgttgctcgcatgaggagatctgatgcattggccaataccatcaaggcttctggagcattatgatacctcagaagttcagcaagaagacttacgatccgctggtttaat

SEQ ID NO: 17360 - DNA, 780 bp, Populus trichocarpa
  Predicted polypeptide sequence is orthologous to G28, G22, G1006
gatcagatcaaaatctctccctctgcctacacaagtacgagtaaaaatgtacggagagaactttcttgatcagtccgattatgcctttcttgaatctgttcgcatgcatttgctaggcgaacctacttctcctaccactgccagcagctgctttaatccagcaagtactaacagtgcaatgtcagcagcagcagcaaccacccctgctacttgtactccagtccctgtttattgcaggagcacaagcttcagcagcttgtacccttgcttgacagaaaactggggagacttgccactcaaagtcgatgattctgaggatatgttcctttacggtgtcctcagcgacgccgtcaccgttgggtgggtcccatcactcaaaaccgatcaattcattgagcccaatcttccagcggtgaagttagaaccctctgagaacttgacgatatcccctccgcgcacggaggctccgatagctgagccggcggtggttccgtccaaggggaagcattaccggggtgtgaggcagcggccgtgggggaagttcgcggcggagattagggacccggcgaagaatggggcccgggtttggttggggacattcgagacggcggaggatgcagcgttggcttacgaccgtgctgcctatagaatgcgtgggtcgagggcgttgttgaattttccgttgagggtgaattccggcgagcctgccccggttagagtgacttccaagaggtcatcgccggagcggtcatcgtcggtggagagtgcgtccctgaagag

SEQ ID NO: 17361 - DNA, 885 bp, Populus trichocarpa
  Predicted polypeptide sequence is orthologous to G481, G482, G485, G1364, G2345
ttttttttttttttttttgatgatgaaggcaccaaccaaattcaaaccacccccaacaaacaaccaaaaaccaaagccaccaaaatatatagggcactttggttccaatcagatcaactaatgcgagagattagattctacaagtgttggaactaaaaagttttaccaacgttacaacttacaattcactgaattgaccaaagcaaagccaaaccctactcgttgcctggcatggaaggaaggatcatatgctgtccctgcacttgtggactcgtatagttcatcgatccttgaaaagcaaactgtgcattttgaccaggcagacctccaactgcatcccgtttagaagatccatctccacctctagcagacccctttgcatcaccctccaactgtgacatggcagtgatccaataaaaccaatcggtgaaagagaaggaaagagaagagtcagatgattagattacaaaccaacctatatgtaaacaaaataaatcatagacaagaaaacaaactaattacctcccggtacctagccaggtacaccttaagtggctcaatataatcctcaaatcctaacgttgccattgcccacaacaaatcatccccattgatcgtcttcctcttctccttctgacacttatcactcgcctcgctggtaacaaagctaatgaactcagaaacacattcctgaacagtatccttagcatccttagcaatttttccattagccggcaacgccttcttcatgatcctacttatattagcaataggcaggtatctatcctgctctctcacccctgaccgcgggctctgctcaccaccactctcgtggctccccgccgccggactggtcggattatcggccatcttactaaaaaatct

SEQ ID NO: 17362 - DNA, 849 bp, Populus trichocarpa
  Predicted polypeptide sequence is orthologous to G481, G482, G485, G1364, G2345
ttttttttttttttttttattcttttttttttttttttttttttttttttttttttttttttaaaaaaatcaccgcatcattaaaagatgccccggttttatatataaaaacagagggacatacccttgccaagtacccattctaaaaatcaagacacaagttacaagttcccattatttacaatgcttcaagagtcattctacctccgatagatacccaaattatacaaatcttaccggaaacaacccaggatacaacaagtgaataaaaaccactcaagctgtcagtgcttacaccataccaatgttttatgttttgaaacactattggttctaggaactggatgaaaaattcaataccgtctaaatgacaaaattcattgtaaaaaagcacatatctactcgttgctttgcatagggaccatcatgggcggagcttgaaaatttgaatttccataactaacaccttgggagaaaaaaccttgatgaaaaatctgcgcatttggaccagggggaatatcctttttagcaaatgtatctccagtcttcgcaaatcccttggtatcaccctccatctctctgtatcgagacaggtaaatcttaagaggatcaatataatcctcaaaccctaacgtagccatagcccaaagcaaatcatcaccatttatcgtcttcctcttttctcgctgacacttatcacttgcttcgctagtgataaagctaatgaactcagaaacacattcttgaacagtctctttagcatccttagcaatctttccattagcaggtagcgctttcttcataatcctactgatatttgcgatcggtaagaacctgtcttgttcacgt

SEQ ID NO: 17363 - DNA, 704 bp, Populus trichocarpa
  Predicted polypeptide sequence is orthologous to G481, G482, G485, G1364, G2345
ttttttttttttttttttgatgagaaatctggaaaatttatttgccaaatatcccaatataagatgattatgatagggttgctaaaagttagcactataaaataaagacaaggaggtacgttgattgactaaaaacaagaaatggcagtaactcagcaacataaagctccatttcacctgcgcatttggaccagggtgaacatcctttttagcagatgtatctccagccttcgcagatcccttggtatcaccctccatctctctgtatcgagacaggtaaatcttaagaggatcaatataatcctcaaaccctaacgtagccatagcccaaagcaaatcatcaccatttatcgtcttcctcttttctcgctgacacttatcacttgcttcgctagtgataaagctaatgaactcagaaacacattcttgaacagtctctttagcatccttagcaatctttccattagcaggtagcgctttcttcataatcctactgatatttgcgatcggtaagaacctgtcttgttcacgtacattagaattagagcgaggactttggtctccgctctcatggcttcctccccctggactcgccggtgcctctgccgccatatcgaaaaccctaactcaccaccaataatcataattgattgatcaaaacagcaatcagaggaagataatttagagagggagagagagagaga

SEQ ID NO: 17364 - DNA, 916 bp, Populus trichocarpa
  Predicted polypeptide sequence is orthologous to G481, G482, G485, G1364, G2345
ttttttttttttttttttggttctaaagatttgctcgatttagaaacagatggaatgaccatcgcttcccttttttggagtacagaggttgataaagagaaagtaaggattaacgaagtgacaaatggcaaactaaggacataaattcacctttcctaaaagggaaaggtgggcaaaacctaagacccttcctcctctcttctctctttctttctttcatctgtcagaagaagctcaaattaagccgtcacttccactacttccaaaactcccagggatcttgatgccacaattatcaacaataagaacagaaaggaaaagcatgcgctaaaatcttgatctgattaacattgaaaacgaaaggaaatcaaaacccttttcattactaaaacttgacagctacgtactactgatcaaagagggaaagtaatgacgggctctctctacatgtgaaaacaatacttttatcatcgtactagtacagacattcgtttctgttcttttccatcaattagcaagcactatttcaagcaactctgtcatcagatgttccatcgcattactttcttcttgtactactgctatgcaccatcatcaatacctaccttgaattaccttgatgatgaaacccaccagcaccgtacacgtgtccttgatggtgatgacccatcatcatcatcccgccatacatcccttgccccccaccaccattaaaccctccacctccaccgccggtggaattagccccgcctccacctcccgcagcaccactcccaccagacccaccaccaggaccatccttctcccctgctggtcttcccatggaactcttctctccttccatctccctatacttctgcaagtaaatcttcaagggctccacgtactcctcgaaccctagcgtcgtcatggccca

SEQ ID NO: 17365 - DNA, 514 bp, Populus trichocarpa
  Predicted polypeptide sequence is orthologous to G1760, G152, G153, G860
ttttttttttttttttttggcaaaaatatctctaaatgtttcatatcattgatcacagttgacgccacatccgccagaaaagaaaagctaccagactttctatgtatttatgaacagggtttttttttagcaccatattcatggacaaagtataagactctggcaccacacctaatacttgcctctgtgacattgcaggcaattgatgggagaagaactgtctggtttgagcgccaaggatctacagaatctagaaaaccagctggagatgagtttgaaaggagttcgaatgaaaaaggcaaagcctccctgatctcaagatcactttttatatgcacatgcagcatgcacataatgctgatgcagcctttttctttttacacaggaacaaattttaactgatgaaattaaagacctgaacagaaaggttttccaagactattgacttcaataattctcgaattgattgtaaagacattctcatgttcactggctttcatcggcttcattgcag

SEQ ID NO: 17366 - DNA, 882 bp, Populus trichocarpa
  Predicted polypeptide sequence is orthologous to G1760, G152, G153, G860
ttttttttttttttttttcatacaagaaccaatctcaacatttcattaactcaaaaggatatacacaagtctgtctgtgcatgcgctatgcacaatgattttctattatgccaagccatgttcaatttaattttatcctgcaaccaaacacaatagtgacgtcgccatacaggaacatttacaaaattcataaacaaaattcctctgtgcaaaactgaatacacgaccatctcattaagtgttctctgtagactgtagcatgaacatgcagatttataaggcaatcacttcttcaagcagctctcatcaattctattctactccaaattattgcttgttatatgatgcacttcattttctgctcactagttgtggaaaagggaggcagcaagcttggggaaggaactgcagtgcttgaaagaatatcatcggtaaagttaattatcactgaatattctcaatagaggatctcaacaacacgtcaccgttggccttaaaataatggtgtaggctgtgtggttaaaaaaatttacagccatgttatgtttcacatcatcgatcgcggttgtagccacatctgccacgagaaaaactaatagatttatgcatccatggacaagttttctttctaacactatattcatggacaagtataaaactccggcaccatacctaacatttgccttgagatgttgcaggcaattgatgggagaagaactgtctggtttgagcatcaaagatctagaaaatctagaaaaccagctggagaagagtatgaaaggtgttcgaattaaaaaggtaaacctatactgatctcaagatcactttttgtacatgtatgcagcatgcacttgatgctaatgcagcctttttttgcacaca

SEQ ID NO: 17367 - DNA, 813 bp, Populus trichocarpa
  Predicted polypeptide sequence is orthologous to G1945, G2155
gcaaacatgaaaggtgaatatgtagaacatcatcagtcgaagcatgaaaatactccaaacatgttctccaaactccaccctcgtcatcatcagcaccttcccttctctcaacaatatcaattttctcgcgagtcagaggaggaagatactcgtagtactggagcagccgccacacccaatctcacacccaccacacaaaaacagaagctcaacgagccaaacagcagtggtggcactgatggtgccactattgaagtggttcgtcgacccagaggcagaccacctggttctaagaacaaacccaaaccacccgttattattacccgggaacctgaaccctccatgagtccttacattctagaagtcccaggtgggaacgacgtcgttgaggctctatcccgtttttgtcgccgaaaaaacatgggaatctgcgtcctaacgggatccggcacggtagctaacgtcactctgcgtcagccatcggcaacaccaggagctaccattacgtttcatggaagattcgatattttgtcaatttcggcgacgtttttgcctcaaacggcatcctatccggtgcctaatagtttcaccatttcgcttgcgggtccgcaagggcagatcgttggagggattgtagcgggaagtttggtggcggctggtactgtttttgttgtagcggcgtcgtttaataatccgagttatcaccggttaccgcttgaggaagaagggaggacttctgggtctggcggtggcggggaagggcagtcaccggctgtgtctggtgcaggtggtggagaaagtggacacgcggcg

SEQ ID NO: 17368 - DNA, 839 bp, Populus trichocarpa
  Predicted polypeptide sequence is orthologous to G1988
tctctctccttatttatctcttcaaatctttaaagagactttcacgacatcgctcaagctttcttgatttgtaatattttattgctctgacgttgattaaagcgtgaaagctggtgatcataaagaattaatggctgttaaggtttgcgagctttgcagaagagaagctggtgtctactgcgattcagatgctgcgtatctttgttttgactgtgattctaacgtccataatgctaacttccttgttgctcgccatgctcgccgtgtaatctgctccggttgcggttctatcacaggaaatccattctccggccacaccccatctcttagccgtgtcacctgttgctcttgctcgccaggaaacaaagaactggactccatctcctgctcctcctctagcactttatcctccgcttgcatttcaagcaccgaaacgacgcgctttgagaacacaagaaaaggggtcaaggccacgtcatcttccagctcagtgaagaatattccggggagatccttgagggataggttgaagagatcgaggaatctgaggtcagagggtgttttcgtgaattggtgcaaaaggctggggctcaatggtaatttggtggtacagagagccactcgggcgatcgcgctgtgttttgggagattggctttgccgttcagagtgagcttagcggcgtcgttttggttcgggctcaggttatgtggggacaagtcggttacgacgtgggagaatctgaggagattagaggaggtatctggggttcccaataagctgatcgttaccgttgaaatgaagatagaacaggcgttgcgaagcaagagactgcagctgc

SEQ ID NO: 17369 - DNA, 790 bp, Populus trichocarpa
  Predicted polypeptide sequence is orthologous to G1988
ttttttttttttttttttcttttttttttttttttttttttttttttttttttcaaaaactatacgagagaagggattagcttaacacgagtcgttttcgtaattgtctcaagatatctttatttttctgacaaggtttctttttttatgtatgttaatcttcacaaataaaaactcttaaaaaacataaaaaattcctaatttccacacacctgggaacttatttgacaacgatactctgaagtctgaacgggccgctcaggcaaagcagtcagtcgagtcagcccaaccttcttccatatttttatgcagctccaatctccggcttcgcagcgcatgttcaatcttcatttcaacggccgatatcatcttccgcggcaccccaaatacctcctctaacctcctcaaatcctgccacgttgtaacggacttgtccccacatgatctgaccccgaaccaaaacgacgctgctaagctcactctgaacggcaaaaccagtctcccaaagcacagcgccatcgcccgaggggctctctgcaccactaaattaccattgagccccaacctttcgcaccaattcacaaaaacacactctgacctcaaatttctcgatctcttcaacctccccccggaaaatcttgccggaatattggtgacgcagctggtttcgacaccttttcttgtgttctcaaagcgcgtcgtttcgggggttgaaatgcaagcagaggataaagtactggaacaggatgaagagcaggagatggagtccaattctttgttttccggcgag

SEQ ID NO: 17370 - DNA, 785 bp, Populus trichocarpa
  Predicted polypeptide sequence is orthologous to G2
ggcggatcataatcttgatttgagcttgggcaatccagcttcgaagcaaaacagtatagaatttggtcaggataggcacaatgttgcaatggagcaacattcagcaaccatgccatttgaacctaattggcaaaatcgggggcttagacccaagcagcttaacctttgtacaagtgacaatgatggacatggaagagatgggtatggagagactgaaacgactcagcttcttagcaaaatccacattcaatctccagcatcactcaagtccagtgaaatgccaagatatgagcagttcaggagatcactcggagatagtcagatgcatccttttcttcccccacagtataactcaccaaattatcaaactcagcatccaagcagcagcaatggaggccgaattggaagtgatctttctctctctccatctgagcttcattataaccatcattatcagcaatggcaagcaggtcctccccggtttgcaaatgctgcagcatcatcaggattccaacagcagattaggactccacaaaactggctgcagaaaaatgggttcaactctctcatgagaccttcttaacccatacataaagtagccgttccatcttccttgctatgcaatctcaatccccaccttgtttgctagctgggtaaaacatgtaaagagcaaggcttttaactacgaggcaggttgtttttcaatccactgtccacccatccccagagagaaccaccaccaagaaaatcacgaaattgttggtcaaaaaaaaaaaaaaaaactc

SEQ ID NO: 17371 - DNA, 677 bp, Populus trichocarpa
  Predicted polypeptide sequence is orthologous to G4
gaccgaaccccaaaaatattttacagaagaaaggaaaatacaatttgaccacttgtctctcaaaaaactcccatttacacccctgtgaagcaaaccaccagcatcatcaacctcaagcagcagcatgtgtggcggtgctatcatctctgacttcatacctccgaccaccaccgctcgatcttctcggcggtttgcggagggattcgagtggtttggtatgaagaaacccttagacaacaagaagtactcgaagccagttgttattaatcttgacgatgatttcgaggctgactttcaagagtttaaggatgagtctgatgtcgatgagaattatgatgtctttgttgatgccaagcctttttctttctctgctactgcttctgcccctgctaagaaacgttctgcgcctgttaaatctgctgaattcagtgggcaagctgaaaaatcagcaaagaggaagcgaaagaaccagtatagaggaatccggcagcgcccatggggaaaatgggctgccgagattcgtgaccccaggaaaggggtacgtgtctggctgggaacgttcaataccgcagaggaagctgcaagggcgtatgatgctgaggcgcgtagaattcgtggcaagaaagctaaggtgaactttcctgatgaagctccacttgcttcatcaaagcagtcaa

SEQ ID NO: 17372 - DNA, 888 bp, Populus trichocarpa
  Predicted polypeptide sequence is orthologous to G4
ttttttttttttttttttcacacaacaaaaaagaaaataacataattaatcatcaattgccagtttacaaaaaacatctgaaataacaaaaaaatgaaaagacaagacactgccgtcgccgttacagaggtgccgaggtgacaggaggagctacacaaacatcatcaaagttccaaagattagccacaaggttttcctgtgtggaaccatttggtgccatggattgcccgtccagatagggaatctgataaaacttcatgtaattctcatacgcaattaactcctcggtcagtttctgtacctcgttttcttcctctccagttcccaaatccaccaccaccacctccttattcttcaccttctctagcttctcctccacttccagcttcacttgacccatataaatattactcttcacgttctgattacagcccaccagtcttgttccctcctctgaagcggacccagaatcatcctccccagaagcgacaattggctggccattaaaaccatttgaagagtaggctccaacctgattcataccagatccgtacccaaaatcataaccttttgagaaatgacaagtgggggtttggtacacaggaggcttggtatttgaattttgagaggaggagtaatgttcatcttcgttgggaaaattgactttggctttcttgccgcggattatgcgagcctctctgtcgtaggctcgagctgcttcctcagcagtattgaaggtaccgagccaaacacggactccttttcttgggtcacgaatctcagctgcccatttaccccaaggtcgttgccttatacctctgtatagattcttcctctgcctcttggcattgggcttctccacttgctcatgatcccctgaagcggggt

SEQ ID NO: 17373 - DNA, 847 bp, Populus trichocarpa
  Predicted polypeptide sequence is orthologous to G4
ttttttttttttttttttcctgctattgcttctcccacaccgaggctttaagcatgttcagctgtgttgtactccattcccatctcagataaacaaccattcctacgagcagcaaaatgaaaggaggcaattatcgatgaaactcataatagagtaaaacaataacttgtagagatgaaactcactaacatgtagccttattatttacaaaacctagcaagcacagaaaagttggctcaataaactcccccaaccatggaggggaagtcttcgaagctccacaagtccactgcgtttgtgccatcctgagttgtgtctccattaaggaagctatcaagagaagcctcccagttacccacaagatctggcatctgaaggttcatcaactgattgtcaaaagccagcaactcttcggacagagatttcccattcttctcttcaacaggcactgcattctcagagtatgatttcaacttcttaggattagcatccacaaagacggattcatcaacttctggagttgctgcaagaacagacaagatttcagggccttgttctccccacccaaagtcacaatcaaatgagttgctccccttgtcagaattgaaatacatagaagcattgtcagaaggagtcaagggcgtcaccccagaatctccaatggccgggaaagaattcattaatccaaactggctcacttgtggtttctcttccacaaagcccatattattataatccgtttctgggttgctcaagtaactaaaatcctggcttaaatttgccttcgtaagtcgtttctgtgagttttccttaattggatgcctttgctgaagcacatggagcttca

SEQ ID NO: 17374 - DNA, 920 bp, Populus trichocarpa
  Predicted polypeptide sequence is orthologous to G5, G974
ttttttttttttttttttggacaacaaatccttatataatgaccatggacaccaaacaagaaaatacaaatgtctccatggctcagctggagataaaaagaccagctaaccatggatggaaatttacatgatacaaacattatttacctatcattaagaacacctagtacaatataatctcccaactacaaacttgataactaatcttggcacttctgctgcaactgccaaaaacttcatcgcagcgaccaaatccctaaatctaaaaggcaactaaaaataacaataataggactagacaataacaaaacgaatctaagataaaattgaagcccaatcaatctcataagagggatacttctgcaacataaaattccccgattcaaaatccaacggtgcttcctcaaaatccggaaacgtcagatccgacaaaggcgaagatccacccgacgcagtactctccgtcaatgccggggactctgtctcagccttaacaaccacttgctcctcctcctgggtcaccactgccaagttggctttcttcttcgtcgagttactttgcctctttgctttccctccttgtttctgctgcgaagagttctccaagcttttacaaatagcttgaagtttcgcatccactgaggaatggagaggcttgtattcgccgatgtaggacccttggtggagtaagtttgggaagttcagtcttgcaaagtcgcctcttagtttataagctgctctgtcataagccaaagctgcctactctgctgtgtcaaatgtgccaagccagagtcgggttcggttcttgggcaaacggatctcagcgacccatttgccccagtgcctttgccttactcctctataaagttttgtggcttttggtggtgtgccgatttgtttcatggggatcggctttgggg

SEQ ID NO: 17375 - DNA, 889 bp, Populus trichocarpa
  Predicted polypeptide sequence is orthologous to G5, G974
tttttttttttttttttggacccctaaacatcatcgcatgatcatcatatttttacagaaaataaggttggattgatatattcaaagacaggtgcttaattacactgactgacctaaaaatacaaaccagacatagaaactcctccatggccaagcaaggaaaaaaagtaccagctagacaaaaaatagaaagagacgaccctactcttacatattaacagcataataaataaaaacttctaaaactgaccgactccccccctagcagcacttctgcaaatgctaaaaaacttcattgcagaagctactgaaagacaactaaaaaagagaaagaaataaaaggaaacaaagattacataataataatttagaacttagatagatgaccagtcaatctcaactgaaggatacttctccaaaccaaaattctcaaactcgtcccattgtaaagaatcagagaaaaagaaagaaatctcagattctggtgaagaagaaccagccaatgactcatcagatagagctggtgagggtgatgggatctccactttaaattcctcaacttcgagattctcgaactcccttttcaattctccttgcaaagaacaatcatcttcaattttcacctgcaaaggagctgaaacggtcttctttgaatcagaaacagaacagggttcccctgtttccccctgtttttgcaaacccaggctctgacaaattgcttgcaacttcgcatcaacagaggaatggagaggcttgtagtcaccaaattcaccagacacatgagctccttggtggcgaagatgtggaaagttgagcctggcaaattctcctctcagcttataagcagccttatcataagccaaagctgcctcctcagctgtgtcaaaag

SEQ ID NO: 17376 - DNA, 906 bp, Populus trichocarpa
  Predicted polypeptide sequence is orthologous to G5, G974
ttttttttttttttttttgcatttcaagtacaacaaattcatagcgataataaagttgaattacatcaagaccagtatggactatggacggacaccaacgagaaaatacaaggtccttcatgatcgagctagcaataaaaggagaccagctaaccatgcttggagatttacctgactccaacatatatttacctaccacaaataactacagacatgatacgagtccgacactaatacaaatacaggcttgatactttggccctgctgcaactgccaaaaacttcattgcagcaaccaaatccctaaatctaaaaagtacataaaaaaaaaaagacaataatacaggacagacaaatttaagataaaattgaagcccaatcaatctcgtaagaaggatacttctgcaacataaaattccccgagtcaaactctaacggtgcttcctcaatatccggaaacgtcagatcagacaagggcgaagatccacccgacccatcactctccgtcaacaccggggacggtgtctcagacttgaccaccggctcctcctcctgtgtccccaccaccaagctggtttccttcttggtcgagttacttcgcttctctacttttcctcgtttctgctgcgaagaattctccaagctctcgcaaatagcttggagtttcgcatcaaccgaggaatggagaggcttgtactcgccgatgtgggacccttggtggcgtagattagggaagttaagccttgcaaagtcgcctctgagtttgtaagctgctttgtcataagccaaagccgcctcctctgctgtgtcaaaggtgccgagccagagacgggttctattcttgggtaaacggatctcagcgacccacttgccccagtgcctttgccttactcctctgtaaagcttc

SEQ ID NO: 17377 - DNA, 807 bp, Populus trichocarpa
  Predicted polypeptide sequence is orthologous to G12, G24, G1277
gtatcctccccccttgttcttctccaagaaacccctcaaaatattgcctctctgctctcatcccaatcccaacgctttatttcttccatgaaaattgttcaagaattcgaaccttgaataagttttttttatcgttttatttttttgagatggaaagtggagtagacaaggatatggcaacaagaaagagaggagggatagaaagtgagaggcaatacaaggggataaggatgaggaagtggggaaaatgggtggctgagataagagagcccaacaaaaggtcaaggatttggcttggttcctactcaacaccagtagcggcggctcgtgcttatgacaccgccgtttttttatttgagagggccatcggcgaggctcaattttcctgaagttttggctgcagagggttttggtggcggtggatcatgcggggacatgtcagctgcttctataaggaaaagagcaactgaggttggagctcatgttgacgctatcgagacagcgttaaaccaccaccaccaccaccaccaccaccttcatcatgatgaccgtcaaagaaacagtaataatagtagcagtagtaatgataataatgaaacggtcgttgatagtagagagttgaagccacggccggttgacttgaataaggtgcctgacccagaggattccgatggagatgagtggaagaggagttaaccaccggtagtggtacggtgggaaggtactgttatatggctgatcaaaatcatgaagccttgtatgttggattaatcaattttaaagttagtagtagtattttacttacta

SEQ ID NO: 17378 - DNA, 772 bp, Populus trichocarpa
  Predicted polypeptide sequence is orthologous to G15
ttttttttttttttttttgctaaagaggaataaaaagtatttcctagcctaaaatgcttgattaaagactaaatttttagaagtgaccgtagtcctttaatactaagctgtggatattgtaatgtgctaaaagtgtttgattaaaacaaatttcaggtacccaagaggaagctgctgaagcttatgatattgctgcgatcaaatttcgtggggttaatgccgtgactaactttaacataacaagatatgatgttgataggatcatggccagcaacactcttctagcaggagagctagccaggagaaaccgagatacggaatctagcattgaggccattgattataactcatcaacacacgacaatggtgttctataccagtcatcgcaggaaccgccaaatgcctgtggagaatcacttgatcagaagtcgatgagttctggaaattatcgaagttcttctttctcagtggcattgcaagatcttattggtatcgatcattcagtgaactctagccagctagtggtagatgaatcagccaagctagggactcttctctctaacccctcatcgttggtgaccagtttgagcagttctagagaacctagccccgataagactgccaccactatgctcttcgctaaacctccactggcatcaaagttcgttagccctacaactagcgtcactccttggttccaagctgcccaattgcggccagcggcaatccccatgtctcacttgccagtttttgctgcatggaatgatacctg

SEQ ID NO: 17379 - DNA, 761 bp, Populus trichocarpa
  Predicted polypeptide sequence is orthologous to G15
ttttttttttttttttttctttatataagaagggccagccacttcctactatattgccaacatcatttcacagcacagaatttaatcatgagactactacttctctatcccttttctctccattttgcaaaatgttcattccaatatcgagcccaaaaggtcaatttgacaaaggttcttacacttgggttacagacaaattactggcccccacccttgtctttcattaatccccggtttcctccactaacctcctaaaaagaaaaaaacatcatgaaaattcctgccttcacccctccttttccctccttaaacagtaactcttccttttccttagttcatgcaaaaactccacatgggaaccgctaacacaaggctttaggtatcattccatgcagcaaaaactggcaagtgagccatggagattcctgctggcctcaattgggctgctgcttggatccaaggagtaacgctggttgtagggcctatgaactttgatgcccgtggaggtttagcaaagagcacaggggttccggtcttgtcagggctagcttctctagagctgctcaaactggtcaccaaagatgaggggttcgagagatgagttcctcctagcttggctgattcatctaccactggctggctagagttcactgaatgatctatacccataagatcttgcactgccactgagaaagaggtgcttcgataattcccagcactcattgacttctgattaagagattctcactggcatttgg

SEQ ID NO: 17380 - DNA, 541 bp, Populus trichocarpa
  Predicted polypeptide sequence is orthologous to G15
ttttttttttttttttttcgaagcaaaagagagaaccatacatactctatttgttttgttctgtacttgagagaggcaataaagctgagtctaattatgaaaatggtcatcccatattgcacaaatcattccatagactccaatcatattgtttttaaaagcttccctccaccattaaggtcaagaaaaggaagagtttgaatatttgaagctcttgttcatgaacaaaggtcccatgcacccaagtgtcgtttaatttaactaaaagaaaacccaaataaaaaccaatctctttctttggaaacctgtttgcaaaaaaaacctttgcatcgaagtcctacgcatctgtccaagcagcaaatactggggcgtgaggcaaggatactgcaggcctcaattgggctgctgctgctgatgggatccaagagctgacatcaccatttggactagtgaacaacttggatgctgctgagggcggcattccgaagagcattggcaggcttgctctatcagggcttccttctctagagctacttaaacc

SEQ ID NO: 17381 - DNA, 537 bp, Populus trichocarpa
  Predicted polypeptide sequence is orthologous to G20
ttttttttttttttttttgtgagtatagaaagtctacatgtgattaatgtacatatacattaggatgtctttgtatattctctgaaacaaacgtaagcaaacctgtaaaaagagtaaaagccttatctcggaagaaaaaattgcaattaggacacttttccttggatttttcacactgaaaccttccaaatacctgcttttttttttctcaggttacaagaacatctggctttctgagggatctgatgctaaaatctcccaaattcctgctcttcttttcccaaatagaaggaacatctgccttcctgtaaagggcggagtaagagttgagacaccatcactcctctggccgaaagaaactataagttgaactggtctcagtctttgtaacctcaggatttcgtgaaagtccagtaggaagagcaggaacaagagatgtccaaaggatggggtctactaagggatcgattgtgttgtagttggtcagaagaggagcagacaagaaaggagtcaatggaacatttctttgaagagacc

SEQ ID NO: 17382 - DNA, 893 bp, Populus trichocarpa
  Predicted polypeptide sequence is orthologous to G20
gcgtatgcctggatctgaatactgcagtagtgtaaactatggtgatgatcacgcagccgaaagtgaatatggtggcagtttttgtattgagagaaagatagatctgacaggctatattaaatggtggaattcccacagcactcgtcaagtggaatccatcatgaagtcatcagaagatactaaacatggctgtcctgacgacattggcagtgaacttaaaacgtcagaacgagaagtaaagtgtacccagccataccagatgcctcatttaggcttatctgttgaaggaaaagggcatacacgttctacaatatctgccttgagcattttgtcacaatcagctgcttacaagagcttacaagagaaggcatcaaaaaagcaagaaaccagcactgaaaatgatgagaatgaaagaaaaatactgtcaacaaaatggaccgtggcaaagcagtagagaagtccacaagtcatgatggctgtagtgagaggctgggagctacattaggaataactgggggattgtctcttcaaagaaatgtgtacccatcgactcctttcttgtctgctcctcttctgaccaactacaacacaatcgatcccttagttgaccccattctttggacatctcttgttcctgctcttcctactggactttctcgaaatcctgaggtcacaaagactgagaccagttcaacttatagcttctttcggccagaggagtgatggtgtctcccctttcattccgcattttaccaaaagacatattttccttttaatcgggaaaagaaggagcagaaattagggagattttagcatcagatccctgagacagccagaggttcctttgtaccctgtgaaaatgcagatatttggaagatttcagtgtggcaaat

SEQ ID NO: 17383 - DNA, 807 bp, Populus trichocarpa
  Predicted polypeptide sequence is orthologous to G43, G46, G1419
gcccgaaccctcaatttatccccattaatgaggtttggataagatgacccaaatccagctccaaaacttgggtaaaaaccgtgtacaatgatgctccatatgctgtaaccttgctgcatctaataaattcagggagtcccatttgatgttgatttttcaaagcaaaagtagcaacttgaattcactccctgcatataaaaaactacttgactaccacccatacatccactttttttgctcattttttctgtctttaaaaaatggcaaccccagaagaatcctccacgttagaactcataagacaacatcttctcggagacttcacctccacagatgagttcatcagtaatcttgagtccactgtagccagtatatctgttaaactagagaactccctatctgggtctgaatccaactccccagtatcagaccaaagttactatagcacccaagaaacctgtagctttgaaataaaatctgaaatcatagatttgacacctcctgaacccatgttttcagattcaagtaatcagtccccaccacctgaactcgtaaagatgacagatagagaagagacaatattaaggcattacagaggggtccgaagaaggccatggggaaagtttgcggcggagatccgtgacccaaccaggaagggtagtcgggtttggttaggtacttttgacagtgatatcgatgccgcgagagcttatgactgtgctgcattcaaaatgaggggcaggaaagcaatcctgaattttcctttggaggctggactgtccagctcgcctccggccacgggcagga

SEQ ID NO: 17384 - DNA, 835 bp, Populus trichocarpa
  Predicted polypeptide sequence is orthologous to G131, G135, G155
ttttttttttttttttttagtgaaagttacgaaatacattcttgtgaacaagcacttgtaattgtcagcatatttagtagagattgtgtgatgaatacattgatggctatatgaacgaagggataaatgctcttcttcacttcaataacccatttattttccgatctcccatgtctcaaattgtatcgttgacatggcgaagcatccaagatggcatggtgctaggtggagtttgaacctcaacattctcatttccgttgaggaatcctataatctggaaactgtcacctatagttaaaggagcatgtggtggcattggtggctgcagcggaggttgtactaccggtggcataaaagaggatgagttttggccaaggtttcgctgctcccattgagcttgttcagtcagtgacttctcattttcctttacctgttctgccagtatgttgttctgctcctgcagttccttttcttttttccgcagctcattaagggattcatggatgagttggttctttcttgatcgtatgcgcttaagagcagtatctatttgttgctccaaatattgaagttctttcagacttaaaggatccaattcctgtcctgcatagttccttaggtttctttgcaagatttcaaccctagccatgagcttggggtgctccagagaccagctttcctgatgttcagaaccatttggtacaagctgttgctctagatatgagcatctctcgtatctttcaaggattgattccatgcttgagtcagtggagtactcaaaaagcttccctcttgttgagaaacaatcaaagccacatcagcatcacaagaaaca

SEQ ID NO: 17385 - DNA, 827 bp, Populus trichocarpa
  Predicted polypeptide sequence is orthologous to G131, G135, G155
ttttttttttttttttttcagtctttctatttatggattttattacacaagcaatttagtgatacattacaattatagatacatagagatacattactatcatggaactgctagataattcccaagtatcaagcaaccgatccaacattttcacttcatcagactgaaaatgatttacatttccatacccccacgtcttggtgtatacaaaacagcgcaacaaggagttgatttgattcttttattcgttgaggtagcgaagcatccaagcaggcaacagtgcgttggctcgatgttggattggagcgggttcttcctcaattcccgttgccaggtggctgctacttatgtttaagggctgcattggttgtggccgaagaattgtaggcgaatccaggtcaggattttgctgctcccatgatgcttgttgagctattattgccttctccttttccttgaccttctttgcaagcatgttgttttgctcctggagcgccttgtccttcttttgtagctctgaaatggattcatacatcaactgattctttcttgatctcacgtgcttaagtgctgaatcaatctgatgctccaagttttgaagctctttgatgttcaaggaatcaagatcttctcccatgaaatgcctttggtttctttgtagaacatctacccgagctttgagcttcgcatattccaaagtccagctaccatggttttcgggatcatcatttgcaagaagttgtctctcagcatatgaatatctttcataacgttcaaggatcctctccatgcaggaatcagtagcgtattcaaagagcttccctttt

SEQ ID NO: 17386 - DNA, 672 bp, Populus trichocarpa
  Predicted polypeptide sequence is orthologous to G135, G155
tccctagaaagagaactggactccacactagtttacaccagaggaagaaagaatgaagcaatgatgaagtccgtaacagccctccatcagaaggaacaagatctgacagatgaaaataatctcatagaaagagagatatctgcaatcatcaacaatggcaacctcgccagccagcatggccgtgttgttgaagatccggattgtgttcatccttctccactggacttgtttcacttttagcaagatctcaaaaggacagatggcgtatcccggatgcttacgtctggggaataacatttaggcatttattatacccacctagtgccaggtggtggtcaaaactaattatgaagcatgtaactagttgccagttggaagcacaagcctttaccaagtggcacgtcagcttacctatatatatgtctgctcaggattgggccgttaagttgggtcccttatatgcagtaatagtaggagtgcctgtgaataatttgcagcatgcacggcatgcgtcatgtctaccacgcatgtgggtagatgccgggattgcgagaccggtccgatgaccctgctgctagtagtggcttcaggatggttatcatggttatcatgactactgttgttattatgatcataataatcgctgttattgatgtaaaaaaaaaaaaaaaa

SEQ ID NO: 17387 - DNA, 645 bp, Populus trichocarpa
  Predicted polypeptide sequence is orthologous to G137, G145
ctccgcgtttttttttttttttttgctcagtaacttcattgttggaaaagaagcaaataatcatagtagaaacaaattaagtcttctcaaagttgcttgcaataattatgaacttcttacatgcctcttgtccctggcgtaaagttctgaaatccagtcacagaagttttcatgtccaaatgaaagtacacatgctcttgaaatcatttacacaatacccacaccaagagagaaagttacatagtaggtgttcctttatgagcaatgaagagcacgaaactcaaagcatccatcctggaatgaacccatggacttgctgggtggcatgtgttgttgcagtcatctggtctgaaccaacaggggtgtagcctatttgcaaagtgggattgcattctaaagcctggaatagcccctgagactgagcatgctggtggccgtaggacatattttgctgatcatcaccttcccatgatgggcggaggctatttcttgcactgatttcatccagctttattgtcaaacctctgttagctttcagcaacagatgttccttattttgaagatcagcaagttggtcgagcatatactgggtcttagttgaccgaacttggttcaatgacgactctaactgacgctcgagctgct

SEQ ID NO: 17388 - DNA, 919 bp, Populus trichocarpa
  misc_feature (816)..(816): n is a, c, g, or t
  Predicted polypeptide sequence is orthologous to G138
ttttttttttttttttttgcaatgacggaaaaataagcttttgatttgttggaaatgcttggaaacaagagttaagatgcttggtcgtctggaggaaacttatgcacataggctcagataagatagagaacagaggcataaacagtggaaatgcaactttggcagcaagacaatgaaggtaaatgcaggctactagtacatgcacgtgagatcaaagaggtaactactagagtgtctgccattgtggcgcacctccagcggtaagttgtcacacatgcagtgctgccttactatttaagcaaacacagtgttgtttgttgtggaggatgacccaaagggtgatccaccttgccgttataaatttcaccaccattcttcattgctacaatctgtttctgtagcagttggttttcctctttcagcatcttttccttgtcctggagagacttcaccgaatccagcatcagttgcatctttctagctctgacatatgttagtgcagcatcaagctgtgtcgcttgttgcacaaactcactcaaggtctgctccccaggacatgtaccttcaagtttcctttgaggtatttgcagtatctccgcagctgatttcaaatttgcgtatttaccaaagtatacctctgaatcattagcacctttagatgaagtagccatcacttcagaatgactcttgtaacgctcgaggattttggctatactgccaacgctagagaattcatagagcttgcctccatttgaaaaggtgaggagagctacttggacgtcacaaagaacagagagttcgtgagctttcttaatncatccatttctcctctttgagaaagtaacttggcgactgctcttgttttcgattcgttttagctctactttcttacgacccattctctctgcctatctatctc

SEQ ID NO: 17389 - DNA, 853 bp, Populus trichocarpa
  Predicted polypeptide sequence is orthologous to G142, G148
ttttttttttttttttttagaataaatactgcaatgtcattaattacttgagctaattaaacacgttcatgttcatcaaacatcaacaattttggaacacatcttggaacccattaatatctcatatatcatacacacacttgaaggacttataatacttcacgagagccatcttggagtagggttgctctttcctggaatgttagtcctggcatcaaaggcttgttcttggtaaacaaattgatggtgccccatctgtaaagtgggtagaggttcagaatgcttatatccatctgccttgctagggtctcgtacaccttgaatagctgggagacgcagaacaacttcctctagcttggtcttgagctgtttgttttcctcttcaagctcttgttcctttaggcgtaactcttccattttatcaaacatcagttgtgtcttcctttgcctagcttgtgaaagagttttgtcaagctgtttctcaatcttctccaactctttaaatgcaagtggttcaagatcttctccaagaaaattcctttgagagcgttgaagagtctcacattttgcccttaacctggagacctcttggtataagttatgtgacccttcctcagggatgttggtgtcttgtgtgctgtagcaacattgtcgatatcgctgaaggatactgttcatatcaatgctactaaactcaaaaagcttgccatggctagaaaagatgataagagcaacctcagcatcgcaaagaagcgagagttcataagcttttttgagcaaaccatttcttctcttggagaaagttacctgacgactgatcttgttctctatcctctccaaaaccacctttccc

SEQ ID NO: 17390 - DNA, 905 bp, Populus trichocarpa
  Predicted polypeptide sequence is orthologous to G154, G627, G1011, G1797, G1798
ttttttttttttttttttgcaacttgaaaacttataggatatatgggtacaagttgatctacgaactcatagcactctctgttcactttgttagtaatgaagtgaaactgctaaagtgttttattccttaggcatggtacccaaatctgatcaacaggaaagcctacagtcataatattatctctacaagtataccaaaacactcaaccctgacttgggcgcctagaccgttatctgcacaattcagatttatttgaggtccatatgcacgagaagtagagtttataatacggattttcactaactctatatgcctctatatcgtacacaaaaacttcaaatcccagagagaaaaataattagaaaggaaaaggtatgagaaaaggaatcactaggatcgtagaagaggataacaagagaatcccaaagtcctgcaaggatcaaggtctgtgctactatgtgtacacgtgtctgacttgtttgtttctgagagagaggcacactaatgagatcttgcatatagaaccctagggtgcaggaaccataccagcatggtacatgaaagtgaaaaggaaaaacaatgcaggaactcaaaagctttcatggaaagaggagggtggtttgataaaaaaagaagaagagagtgatacatgaattaactctacatatatatatgtataaaccatggaaggaaagctgtgcaaaagatgataccttgagcttccaaattcatagagcttccctctaggagagaagacgataacagcgacctcagcatcacaaagaactgatagttcaaaagccttcttcagcagtccatttctccgcttagagaaggtgacttgcctgcttgtagcgttctctatgcgcctcatttgagtctttcctctcaccattttctctta

SEQ ID NO: 17391 - DNA, 764 bp, Populus trichocarpa
  Predicted polypeptide sequence is orthologous to G154, G627, G1011, G1797, G1798
ttttttttttttttttttatccccttttttttttaggcttctctttgactttctcatatgatggttcaaacaagtttaatagcatggtagagaatcaatatatatatatatatatatatatatatatatatatataatcttccaacagatattttaactcatcgcacaatggtatagttcaactccctttttgttatgtaatatatttgggagagtttatttgactcgcgacattagctatcagatgcaaatgatttgaaaaaaagaaaaaaccattgacacttgggaagctggaactgtattgcaaatttgaaactgcaattattcaagtcttatggttttggggcaagccgtgtctctggtggtcctataaacaattctgtctccacctccgtaatttgtcggtcttctaatagttgttgcttcctggttgatgagaggtcaggttgttgcatcccacacttctcccgtaacctcgtgttttcttccaacaggattttctcctcgcctttgagcttctcaatccgctccctaaataactggttctttcttgccctaattcttgttaagcttcgccccaactggttctccaactgttgtaggtcatcagtggaacatgtttccaatccctctcctaagagcttccttttagagacttcaagaagctcgatcttcttggccagagtaaatgtatcttccttcacaggctgtatattgtcttgaaccatcttgctgctgattcctacgtccttggctctcttctg

SEQ ID NO: 17392 - DNA, 486 bp, Populus trichocarpa
  Predicted polypeptide sequence is orthologous to G154, G627, G1011, G1798
ggtttcaggagaagctactggcagctgaaaatgcaagactgtctgacgagtgtggtgcacagtcatggccagtctcaagggaacagagagatttaccccgtgaagatctgagagaaagcagttcaatttcggatgtggagacggaattgttcattggaccaccagaaacaagaacaaagcgcatccctccaagaaactagtggtgaatgccatcttactgcgagaccaaccttttcatattcttaagactcttgctaatgctatgttgcacctgcgcaagcaataattaaggcaatagtattattttaagagaaatatatatgctgtctgttaaaaaagctaccatgattgattgagatcaactgtaaacagagtacttaaatattgtaattaggtatatatttgacgtatcgttagacttttccttgtatgtttttctgacaataattttcttaaaattattctgtcaaaaaaaaaaaaaaaaaa

SEQ ID NO: 17393 - DNA, 876 bp, Populus trichocarpa
  Predicted polypeptide sequence is orthologous to G154, G627, G1011, G1797, G1798
ttttttttttttttttttggcacagagaaagtctaatgatatgcaataaatatatgtatcagtttacaattttagttaatctccttcatggtaggctggtagcttttttaacagacagcatataaattgctcttagaataataatattgccgtggttgttgcttgcgcaaatgcaatacagttaaagtctaagaatatttatgaatatgagaaggttggtctcacaataagagatggcgttcaccactagtttcttagagggaggcgccttgttcttgtttctggtagtccaatgaacaattcggtctccacatccgaaattgaactgctatctctctgttcttcacagggtaaattctctctctgttcccttgagagtactcgccatggctggacgccagacttgttagacagccttgcattttcagctgtcagttgcttctccttttgttttagttgctcaatctgttctctgaaaacctgattctttctagctcggatggtgcttacactcctctctaactgttgttcgatttgttgcagttcttcaacagtgcacgatcccaaacattctcccagtagctttctgaagcattttaaaattaattttcaaacatttacgtataatatttaattccaacagtcaatcaattcatcaaactatactataagcacaaaaggtttaaactaatcctttgaaccgtttcgaaacttcaagaatctctatcttctttatcatgctagctgcttcgcccttcagttgctccatgttcagttcgcttgtctgcttgtttgtgttgctttctttcacatgcctctgataacgttcaattgtctcctgcacgcttgagcttccaattcatagagcttccctct

SEQ ID NO: 17394 - DNA, 852 bp, Populus trichocarpa
  Predicted polypeptide sequence is orthologous to G175, G877
ttttttttttttttttttccttgcaacaaaagtaaaataattataacaacaataaataaacgtttgagaatacaaggaaatggaaaactttacatctgaggcccaagaggcagcctactcatgatttgctgatacagtgttcgattgttggagaggttcagactaggttctgtcactggccccacctttggttcttctttcggcatcatgaaccccatttcgttcccaggatgttgctgcgccaagtatggatgaatgggcataacaggcatctttggttggccctgacctaagccagccattgcaagattggccaagccaggttgattcattccaaatgagaagccaggcgaaggccccagctgctgccttccaggcaggctgaaggatccaaatgcaggaggccgctcaaacctagccatgctattgtgaacctgtgatggctcatgtctgtgaacttgggtttgaacagcaacagcagcttggcctggggtggcattggaggtgccagagttcacatggctgctattgcgagcagcaggaacatcgtgattgtgcttcccctcgtacgtagtgatcactgacttgagatcatgtgatgccctctccacatgctttctaaccgtgcagcctgcactagtacacttgtaataactcctaggatttggatttcctttcacaactttctgcccatactttcgccagcgatatccatcatcaaggatatccacctcactggttgtctggaccacaactctaggctcacgaatagctctggtggctccactcatttcagttgcatatgtttcaattttccttctcttcgactcagattcttctccttcaccatcg

SEQ ID NO: 17395 - DNA, 822 bp, Populus trichocarpa
  Predicted polypeptide sequence is orthologous to G180
tttttttttttaccggaaattcttactactcctgtaatagtgtgatagagtttcctccataaatggattgattcaagccaaattgttgtcagtcttccaaagtccacatagagaatacatcttgtcatatatcaacaggtacgtattaattgtcagaaatggctgatcttgggaagatgaaaacccctcaaaaccatttactagcaaatactgtcataagctgatgatacgttatatattcttattctaataatattacaacagtctttcttaataatttaactaaagtatgtattaattagaaagaggaaaaacattcatgttctgatgaattggaatcatcacatggagagtgattgtgtctaccttcataagttgttatcaccattcgacaatcctctgataatctttcaaccctcttcttgactcgacagttgttgtgagtacaacgatagtagcttcttggatgaaggctgtttttgacaactttctggccatatttcctccatttataaccatcatcaagaacatccacttcactccttgtttgaaaacaaaatcttggttctctaagctttctcctcactttcaacttgttcttgtctgcggatgagctcctccaccatgaattgttgccatcgttgttagcattaccagtgcagttctcatcactagaagcctttggatccattgctcccacctgctggtcattatgactaaaccccatgtgagtattgttggttgtggtagtattagcatttagaggctgagatatctgagaagattgtgaaggggccaggaagctcaagacctggttttctt

SEQ ID NO: 17396 - DNA, 707 bp, Populus trichocarpa
  Predicted polypeptide sequence is orthologous to G181
ttttttttttttttttttggcaattatacttagttccaattcatataaaaactctatcgatctttctagttgtaaaattaaaagaaaaaagaaagaaaaagaagatggaaaagtttacaagttttcactatatacaaagactgatataagatgcccaagaacaacaggtccagctgcttgtgcagaagtgagcttaataattagaacctagcaaggaattgcatctgtttgagaagaggagttagggtttccatcagtttctcacatggatgatcatgaactccttcataagtcgtgacgactatgcttgtgtccttagatagcctttgcacttgtttcttcacgttgcatgtatgatgcgtgcaccggtagtaactcctgggatatttgctgttcttcacggctttttgcccatatttcctccacctatatccatcatcaagaatatcgtctgcacttctagtttggaaagcaaatcttggccgggtcgcctttttcattcttccccctttcttctcatctttatttcccctttcttcctctgctccattttcagccaccatagaagcactttccattacaggcctcttctcgccgagctgggattggccagagagaaggccaacccaatcaatatccggaaggacttgaggttcaattatagaagggtactgcaatgaggaggatggcagtagtaagggtgtaag

SEQ ID NO: 17397 - DNA, 895 bp, Populus trichocarpa
  Predicted polypeptide sequence is orthologous to G184, G186, G916
ttttttttttttttttttgctatccaacatttgatcttatttatatcctcaaaggcaaagaaacaagaggaggcaaaagtccatcacacagccaggtggctgccaaacagatcgtttttcagggccactcaacagtattttgcgtctgtcaggatcgacagactccaagcattagatgtcatttctcaagcatacataatttggtttcagccacagtagtggtagtttgcttcacccaataaggataatgatgaaagttgtcaccgattttgtgatgacattctctcggatccatgcctttggcggaatctgatgccgggatctggaccaccaccagcctgatggaatgtgctccaacctgaatctctgtcaacctgatttaatgagaatgatggcaaatgatctctttcccatgaacggaatcgagttggcggaggaggattttctgctttgggagctgtagagggctgggattttgggttaggtccaatgtaacagtaggaaatggagctgaagcagatatagtggcaagactagaggagcatgggaggatcgttctggtaaggaaatttgagttcatcagtccatcagtactagacatggagcctgacaacagcattcttgccgccgatgatgtggttgatgccattgccgtggcagccggaggcaaagggtggctgtggttaccctcgtatgtagttgtgaggatggtccgatcttctgcgcatctctgtacctgttttcgaactgggcaaccagcagccatggtgcaccgataataagctcgaggacatggatttccttttgccatcttctgtccatactttcgccattggcatccatccgatatcgtagcatcctctgatctagctcgaacagacacacgagccttccc

SEQ ID NO: 17398 - DNA, 847 bp, Populus trichocarpa
  Predicted polypeptide sequence is orthologous to G187
ttttttttttttttttttggagaagaagaaattgtttcattctcaaatgaaaaaaaattacacctccatacaataaaaaaaaggagaaaaaaagggagcaataatggactacatttggagtataataagcgtgcaatcctcctaccgctgggtttttgaaaaaccactgctacgtaccgccctagctttagactcatgaccttcttggattatgaaagcatttcccaatattgtagcaaaattcacctttaatccaagggaagcatgtccacttcagaattaagatataaagaagaaaagaagtattacctaacaagtcaggaaggtaaaattattaaaagcatatgtacactgagagagacccttctcatggctcttgtctaaggaaaatcgaagggacaatgtcttgcaaaagtccatagtccggaacttgatactgctggtgcacatgctgattaacgttttgtggatacgcccccatgttctggttgttcatagcatctgggatttgaacaaaattatacccttgatgatgagggaagctaggcccactcgccatgggcgcaggtgctagcattgaatgtgaaaacatagccgaagcacttcctctaagtgttgttggaatcggatggttgtgttggccctcgtatgttgtaatcacgattgatggatcctggaatgacctctccacacgttttttcacagtgcatttctgagtagtgcaccggtaatagctcctgatataaatataattaattaatatttactgttcatcttatcaagaattgccttcaagattacctttctgtcgctaattaacactcctaattcatttttaagaaattaa

SEQ ID NO: 17399 - DNA, 588 bp, Populus trichocarpa
  Predicted polypeptide sequence is orthologous to G189
gggaaatcaagaattaaaagggtggttagagttcctgcaattagtagtaagatggctgatatcccacctgatgattattcctggagaaagtatggccaaaagcccatcaaaggctctcctcatcccaggtatcctatagttgccttctttgtttccttggttctcaatacattctgggtattgtcggtccttcaatgttcctttcacgtttcgatttatacttggatagccgtgggcaagtccaaaaactcaaccttgattccttttgtttcaacttgtttaggggatactacaagtgcagtagcgtgagaggatgtccggcacgcaaacacgtggagagagctctagatgactcgatgatgcttattgtgacctatgaaggggaacacaaccactctcatccaatcgatgatgcacctggtgctcttgtccttgaatcatcttaagtcaactgatcaatcggcatggaaaagatcttccccagttcattcacgcccgtgcaagacaagacactagtgctcagatagtcaaaaggacaaggctagtgggcacattagctgcctaagcagcaaaaaaaaaaaaaaaaaa

SEQ ID NO: 17400 - DNA, 741 bp, Populus trichocarpa
  Predicted polypeptide sequence is orthologous to G189
ttttttttttttttttttcaatgtctacattaaaaatataattgaggcagacaagaaagtttagattcttgggcagataccagatgatacaagtaattttttctttttaaaaaaacaaatactgggcttctggagatatatagtgctgataatatttcgatttgttccacagaggttactacaagtgcagtagtgtgagaggatgtccagctcgcaagcatgtggagagagctttagatgatccatcaatgcttgtagttacctatgaaggagagcacagccacactatctctgttgcggagacatccaatctcatcctagaatcctcttaaccagatcatcgccatcaacaagaacgaaaaagtgtaacaaacagtacttcttctaaacagcagcggtagcggccaggagctgtggaatcagatgattagctcagctttttcttgaaagagattagagggtcagtccatttgttcatttgcatgtaaactatgggattcttgctgccttcttcttccccgctctagctagaacaactgtgaacccgtatgattttagttaaattgaaaatctaaaaaggaaaggattaaaagatggtggatttggtattagatctcaatcgatctaaaagaaagctaggtagctttgatttttttttttccatggcttgctttaagctctgggttcatgtttttggacgcctacttctcacttttcttgcatcaagctcgtagtttgatc

SEQ ID NO: 17401 - DNA, 758 bp, Populus trichocarpa
  Predicted polypeptide sequence is orthologous to G192
ttttttttttttttttttgttagaatcgttagatgtaccagcttgtggtgttgaggtcttctgacgcgtgctacctgctagagagtttctgtgtgtaggggcagggtggttgtgctctgctgtgtacgtcactatgaacattcctgggtcggatctgtttctctccacttgtttccgggccaaacacccttttgagctgctgcatctgtaatagccccttggatatggagagcctttgattggtttttgcccatatttacgccatgcccacacatctgaagatagagcctctgctggtacttggcatactttctttaactggttctttcttcttttggatcgaggtgtgtgagaatttccactgctagtcacagaaccggcaagagactgcttaggctgtgactttttttgctgttgttttggctgggtttgtaaatccttgttaaaactggcaaacgaagaaaacgaagagataggtgtgcaggcttgtggagaataaaggaggggctgagttttggggaaaaatggcttgtaaagctcatccagttctccaataacatttattgtttcaaagtgatctggatgagagaaaagatggccaacttgctcactgccaaaaccagaaaagcaagaatattgaggataataatctgatctataaccactcgtagtgccgtttctgttgctgttgctgttgatggtggttgtggctgtggtggatgtggaggtagaggtggtgcagcctctgaccacaccat

SEQ ID NO: 17402 - DNA, 838 bp, Populus trichocarpa
  Predicted polypeptide sequence is orthologous to G197, G255, G664
ggtctcgagttttttttttttttttttgcatacgaaagcagttgcgctaattatcttctctttattttcctctttaattatagaacccagagactcttcttcaagtactgaagtagtagtcgtggtgaaagatattgttgttgtggcttcttgtactgctggttcgttgagtggcctatgagttgcgggatctatgcctctgttcaaaagcttccttcttatatgtgtgttccaataattctttatctcattatctgttctccctggtaatcttccagctatgagtgaccatttgtttccaaggaggctatggagtttgataatgagctcatcttctgcttcggtgaaattgccacgtttaaggtcaggtcttaaatagttgatccaacgaagtctgcaactcttgccacatctaagaaggccagcggctttaggaagtgagcgccagcaaccttcaccgtgagctctaatgtaagcaacaaggcgatcgtcttcctccttggtccacgcacccttgtttgtatgggctttggtgcacattgagcgcagacaatgttggctcatcccaccaatacctcttctcaccactactgctacatttcttagcgttatcatctgctgctatcgatgctggacactcacatgcattgatttcaaatcctttgtaggaggccacgaaagggtgcgtggctccaatcagtcttgacacggcgaaaacctgaaactttacactcttctccaatggcagacgaagccaacagaactgctttcttagagcttcaaggtcgcatgattgagaccacttctaaattcaagcaggtccagaaccagatacgaa

SEQ ID NO: 17403 - DNA, 912 bp, Populus trichocarpa
  Predicted polypeptide sequence is orthologous to G207, G227, G230, G242
ttttttttttttttttttacataatagacaaacttggattagaattgaaagatttgttgttttccttgttcttgttgcaagtttttttcagttccctcgtcagaaccagatccaaggttacaaaatgtctccgtttttaccatttcccctcgcccttgcccctctctctctctctctctctctctctgtacaatcccaaaattattccctagccaaaagagaaaacagaagccccagtttcctttctaccctgtccatttttcactacttaattttaccaacccaaccctattattcactgcgacattcctaaacccctccccactcatgccctgataacacatacccccacctacaccactatgttccatcatataattcctcacttccttccttatcatctcttgcatcaccgacataaactctgtattgaaccccacagacccggacagtccgcccactgccggggacacctcctgagccggtgcgttccttcccgtcaaaaggggtgtcactgtattggatttgggcagctgagatggctcgccgacttggttggacacctcagaggaatcggccccaggtagagacaagctcagcgaggtaggcgggtcgttgttgttatcagaagacgacgtcgtttcaactggaggcataaccgctccggttcgggcaacgggccggtatatattataattataagaggaggataaaccgggcaagctggagtcgctgacgtcagatccagaggggctgcccgggctcatatagagccccgtagaaacaggcacaccagaacctgcactcacggatctcttcaagggctgcgtgttatcaccatccaaattaccatcatacccttcgcggttgcagaaattgccatcctctgccattgaagagcacttgcgtttc

SEQ ID NO: 17404 - DNA, 812 bp, Populus trichocarpa
  Predicted polypeptide sequence is orthologous to G207, G227, G230, G242
ttttttttttttttttttccaaattattacttctgtataaagcaacgattaaagcaactttaaagaaaacaaattaaaaaaaaaaaaaaacaagagtttttttctcctttttgccctcctctctcattctctctccgagtcaactcagctgcttcatcatcatgcccagatgatcatgatcatggccgtcactaacaatctacttctcttctgcttggctactcgattctgctaataccaattcgtttaaccacagcgttccttatagcctctgttcccaaacagagcccattttgctcaatcccggacatatagttcctcacttccttccttatcatctcttgcatgactgctaaaaactcagcactgaaaaactggttctcaagtcgagacccaggattcttctgttgcagaaatgaaacttgctcctgttgctgcacagccactgcagcttgtgggggtgcagcaggtgtttgcaccataggtgtcgggttaacaacatgggatccagaacttgagccagaacccggagcctgacaagtaatggatccaggcagagacagggataatgaagtcggtggatcgacggtcggagaggacacgtcaatcgacaaactaggtgggacaagagaggcggttttgactggcggcctgaaaacgggagatgaattcacgccgggtatacttgaatcgctcaaatcggatccggatgggctactcgggttcaagtgtagacccgaacccgccccgagacttgcggatcttttaagaggctgttgttgtgcgtcgtcgtttaagtcatcaaacatgga

SEQ ID NO: 17405 - DNA, 139 bp, Populus trichocarpa
  Predicted polypeptide sequence is orthologous to G208
ttttttttttttttttttcccttaaaccaaaattacattacatagtttaaaaattacaaaatggtccctaaaactccagaaattgcagggaaggacttctgcaagccgggacagtgccgctggaacagtggcggcgcgt

SEQ ID NO: 17406 - DNA, 912 bp, Populus trichocarpa
  Predicted polypeptide sequence is orthologous to G211
ttttttttttttttttttatatcaacttaaacgtacaggcattccatgtaaatacaacactcacaagaacaacatatatatataacacaaattagcacgtatttatagtcgtaacaaaccagtctgattttctttatatagaaatcttctgctgcaggatcaagctagatcataactatttaacgcagtaccatctttctcaccgaaagctgccattgaagatgtgacttcagcttcccaaatactgccatgatggaaagcctgtgaagaagaaatcacaggttgacctgatggtccaataatattacactgttgttgttgttgatacgcaaatacattttcattgatcagagaatccagaaacaaagagaacgtgtcctcattttcatttccaatgtaatcttcctctttgttttgttcatgatgactttgtaaccccttagtaaaaccatcacaattaggccagtttttggcaccatcatcaatgacctgatttggaaactgatccaagttagttattgttaagttcccaattactctagtggctgtagctcgatcgaccctggcattctcttctagtggaaacgaattagggttggagttttgggtggaagcaatattggcaatctctgatgaattagggttagggtataaaggcttgtgggtccttggatcaattccttgactaatgagcttcttgcgcagatgggtgttccagtaattcttgatctcattatctgtgcgtcctggtatcctcccggctatcaaagaccacctgttaccaagcaacctatgaagcctaagaatgagatcttcttcatctggggcaatacgtcctctcttaacagaaggcctgagatagttcatccatcggaggcggcagctcttaccacacctaaaaagccctgcctg

SEQ ID NO: 17407 - DNA, 475 bp, Populus trichocarpa
  Predicted polypeptide sequence is orthologous to G211
gccccccctcgagttttttttttttttttttggcttatttagtatagctagctagttttagggtttcactgtatatatgttgcggattgctcgtgaaagagatttccttcactttttttttgttctcattagagtttggtcaattaacattcgagctggctttgatccatgtataatttacgtgagctctctcttcaattattttatagctagcttagctcgaaacctgcatgaatctggttttcaatgaatcatgtgcttgaatcttgtaaacgatctgtgttcttaaatttcaccttcttcttcgttcaagatttgagctagaaaggaaatgtatatcactttactttgaacaaattttagctagatcttagcttggactagctacttgtgttgatttggtcaatgggctgtttctttaggtggtcattgatagctgggagaattccagggcgtacagataatgaaataaagc

SEQ ID NO: 17408 - DNA, 927 bp, Populus trichocarpa
  Predicted polypeptide sequence is orthologous to G211
tttttttttttttttttttataatctcatacattgtttgggtaatattttggatacaagaaaaaatagtttatgttctcaccaatacaacacaacagcaaatgataaataggatgctgaagtaaaacaataacagtagatatgtagaatacataaaataacaaaccaaatcctagctttgtagtttttgtaaactgattaccaagtgtaatttcatgccttgataaaagcaaagatgactatgatagactactcaacacggtgatcatcaaccctatttcgaatcattttgatcaagagcagaaggcatgagagtagattcccagccagtactaagtccaaatgatgttgcggcagcaattggaaacaaaggatctgtactggctggtgcactattcacattaggctcattaaagatctggtgttgttggaaagcctcctcatttatgagtgaattgaggaaggaaaacacatcttctgtgccagaattgatatcttcagcttctccattaccaagcctttgattacctctcaaatccgtcccaaaagaaccatcataattcagcaaacttgtgtagccacgacttgcaataaaatggtccgtgtaatactgatcacccaggtgtgcattactgttgttttgaaaatacccattctctttgttgctgattatgtgagcactgccactggtagtttcttccaaaccagaagaagcaatcttaataggctcttttaggctttcttgcaggtggttcgctttcgacgaagaaggtttggattgatcaaaagattgaggattgatgagaggcttgtgggttcttggatcaattccttggcttatcaacttcttactcaggtgagtgttccagtaattctttatctcattgtctgtacgccctgggattctcccagctatcaatgaccacct

SEQ ID NO: 17409 - DNA, 839 bp, Populus trichocarpa
  Predicted polypeptide sequence is orthologous to G214, G680
ttttttttttttttttgctagaaaataattatgaactttggaggaaaagggccgtggaaagccaattcaatacttaatggttctaatggttcttaagttcttatctacgtctatttaacggagttcttaaatgcggtaatgggttcaagaaagtaaataagccaatgtcgacatatagtacacacacttacacgacaagtcttgtgggttgcagatactctaatttaaacataaaaggaatgataggcaagcgaggatattataaattacatgcaaaaacaaaggttttcccttattcaagcaagcaatatcaagtatcaaactgaagcttctccttccaaacgtaacctcttggggcctttctcctcgccctggccgctgccggttccggtcctgctttctttggcctccagtgaacaccttttgtaaggtttaaatccggttcgacgaaccttaagctttccatgtccaagcccaatcgtcagcagctcctcctccccatagttttcacatctagacaaagcatttttctccccttcttgatgaccagagcagcactcccacgttttactgttgagatttatcagtgatgcatctccatctttctcatctgcatctttcttttctccagcatcttcattctggtgcatcttactcttcagatcatgtggaggtgagaagctctggggcaatacctctctagcgaagagtgcttgaaatgccagccgcccctcttcggagacctctttccatgaatcattcatgctgctactgcttctgctgtggcgagagctagattcggaagctggatgatttgcatcatcttcttttggctcttc

SEQ ID NO: 17410 - DNA, 782 bp, Populus trichocarpa
  Predicted polypeptide sequence is orthologous to G217
ttttttttttttttttttcccttcaatttcttcaatagtggtcgggaacttaggctgttccacaggtctatcttcgtcagcaacatcataaaatccaggaggaggtctcttctcaaagggaatttcagaattatagtctatccccttccttttccttctccgatgcctattatcaataccagcagccttcagttccctccttttctgcaaggaagcaagcctcctcgcttcttcaagctgtttctccctagcctttcttttagcctttttacctttcatatttgctaacctagctcgtgcttccgaaagcatctccttctcatcctcatccatatcaacaggatccggacgtgcaggcttagattctgggttcggatcaatctcaccaggacgcaacttccgtggatcatcaccaggatcatagttgtcgtccttaacacaagctgcatcaagcagcttctcgtaacgctcaaggcattgtgaaggagtacgtccaacaatcggggcaatcgtcctccactgcgtgggcatgagcttaacaagatgaagcaatttctcatcctcttctctagtccactcggtctttttaatggaaggatcaagccactcataccaacgagctttacattgcttagcagatttacgaacaagaagagaagaaataccagcccattggtttttgccatatttcataacagccgcttttagaatttcatcctccgtgttcttccatactccaccttttatcatgatcctcatcttgcttgccttttcttttgaat

SEQ ID NO: 17411 - DNA, 588 bp, Populus trichocarpa
  Predicted polypeptide sequence is orthologous to G225, G226, G682, G1816, G2718, G3930
ttttttttttttttttttaattaactcaccattaccacattcaagaagaaaccattgtacaaatatcttgatcacaacctaaacccacccatattgcaggctcttagaagaacgctacaaaaccacccaaaattttgctactctagtacatcagatagggcaatcatcttggacaaccctgatttactgacttgtagagtatcttgaagtccagtacttctcaatttcttctgctgttcttcctggaatcctcccagcaattaagggccacctctcaccaaccagattgtacatcctggtgataagagtttcctcatcttctgagaattcaagcttggaatcttggctggtttcctctctagaatcaacagagttgtcatcactagaggagtgatccaagtcagccatatttaagttgaaagaaacttgtgatgaacagaaatttctaatcttgagtctatggaagctgactgagtgtgaaatttaagggatttgataagtggagtattaatagagggaggccataaagattcctcacctcaaaaggtggtcatcaattgatggagaagaatgggcggtggtgtggga

SEQ ID NO: 17412 - DNA, 410 bp, Populus trichocarpa
  Predicted polypeptide sequence is orthologous to G225, G226, G682, G1816, G2718, G3930
ccctgatctcgttccctgtattttttttcctcactgaaactgctcaggggcaaaaaataaaaaaaatggatagacgtcgcaggaagcaagccaagacaacaactcattgctctgatcaagctctttctgtgtgatgatttggtagaggtaagcagcattgaatgggaattcatcaacatgtcagaacaagaagaagatctcatttacagaatgtataagctggtcggagacaggtgggctttgatcgcaggtcgaattccaggccgcaaagctgaggaaatagagagatattggattatgagacactgtgaagggtttgccagtcgacgaaaggaacaaaaaagagatgtaattcctaatacctcttaattaggttgtatcaatttgtttggaaaaaaaaaaaaaaaaaa

SEQ ID NO: 17413 - DNA, 591 bp, Populus trichocarpa
  Predicted polypeptide sequence is orthologous to G225, G226, G682, G1816, G2718, G3930
gatttctttgttttctggctaatttctgctccatttgtgtttttctttctgggtttcatggttattacaagattgaaaattgttagtcctttatcttaagctaccaatttgaaacttaagattggatttttttcatgggttataaatcgcagatacaagccaagattccaagcttgaattctcagaagacgaggaaactcttattactaggatgtacaatctggttggtgagaggtggactttaattgctgggaggattcctggaagaacagcagaggaaattgagaagtactggacttcaagatactctacaagtcagtaaattagggatctacgtccaaggtcctgtctgatgtcctagagttgtcaaaattttggctggtttgtaacaaaatctggttctacttaggaactgcaatatgggggtttagctgtgatcaaaatatctgtacaatggtttttcaatgcggtaatggtagttaattaatgtttgggagctagattgtaagatgaaatctgcttgttaatatggtaaattgagaaatttttacaaaaaaaaaaaaaaaaaaaaagaaaaaaaaaaaaaaaaaa

SEQ ID NO: 17414 - DNA, 868 bp, Populus trichocarpa
  Predicted polypeptide sequence is orthologous to G231, G2007
gttttttttttttttttttggtcttgaactcttcttcgattttgataaaggaaaggagaataattattaagctacatagcacttccaatatcttcctttccctagttcttttccaagatttgaatggtgggatgaagaaaaaatttacaagacttgaaattctactatccaggaagcttgagctttcaatccttgtgcttccttcctcattacttgatacaccttgcgatcattctatgaggtagtgcattttaatgcttgccacccatgtctaggatactcaagtccatgtcactgaaacaactaagtccaaagaattcatctccaagatcctgagagtctaaaacccatggagagttactatcctctgatgaagatttagatagcccgaattcactataatctcctcctctagtggcttgaaagttccaagatgaatcatcaagaaatacctccgaccataggcaactcattagtggatcactgtcagtagtactgttaggttctgatgaccctatgcattcatccactgaagaattttcagtcggggtggtcgtgcttgaattatcagtagtgctagaggaggcatggccacaattttgggggaggacctgctgaccatcagcgttaaaattgggttgatcataattactgtgacaaggtactgtactttcttgcggacttccttgtttattgagaggctcgtgcgtaacaggatcaattcccatctttattagctttttcttaatgtgggtattccagtgattcttgatctcattatctgttcttcccggcaatcttgctgcgattttggaccacctgttgccaaggcaagcatggaggtcaatgacaagttgctcctcatcct

SEQ ID NO: 17415 - DNA, 897 bp, Populus trichocarpa
  Predicted polypeptide sequence is orthologous to G256, G666, G668, G932
tttttttttttttttttgttaagattagaatatatatttatatatattctaatttacactgtctgtgtaaatttattctcgacagaggaaatatgacatattagtaattaattcacatttacactgtccgtgttcttgctctaaagggatgggaacttctaactaatatgaccactgtgaaattgtatcacttcaaggcctagagcaaaataaaaagaaccagtgattctcgaacaaggaatccctttagaaaaaattactagcatattagtctaaatcagaagagcactcaaagtagccacaacaaagaagagccctcccactagaagagattatcttcatctattgtgacttcgtttatgtaatctttcccttgcatggctccttcatcaaatagccacctctcaatcaatgacagtggcacttgagcactggaatttggcttactttcgtcttggaaaaggccagtatcaggcgacatggattgagagaaatctgaatttgaagagtcgaaagagtcaaaaccaaagagtgattcaaatgcctgtgataatccagtgccatttttgtctgctttatcaggagtcccttcactagacagtgaatcagctccagccgtatcgatgaaggaattctgagtagttgaattttttagcgactgcttaggcccacttatcatccatcctttgagcaatctggatatattttcagtgcttgatgcatagattggttctgtagctggtttttcatacccacaagagggtttcaacccggttaacaagctgcttggtttaccgggagacaaggcctcgcatagggcttgcctagccatgttgatatcagtttgaagccttctctcccattggcctctagaaatttgctgtgaacctgttgatg

SEQ ID NO: 17416 - DNA, 836 bp, Populus trichocarpa
  Predicted polypeptide sequence is orthologous to G259
ttttttttttttttttttctgtaaaattgtatatattatacattttcaacaagaaacatatgttaacttcactcaatcatgtagctgacataaggggggcttgtgcccgttttaacacccttaaagatacttggcaatgtacagatcttgttcattactacagcaacaacaacagagaatacaacttcaaacttttctgtgtctaattaagctagctacttcatttttttttgttttagtagctgatgacttgtccttggattattctacaatatggcacacattttatttgcattattgagatagtaaaatggttgcactttctctaatctctgctctcttcctcttcttctccctctccccctcgacttccaatctcacaccaaacaactttggcctttcatcttcctcttctttctccaaatgtgcgtttttagctactaaatcaagtagctccttgcactttcttttcatgctagtaagctcagtgctcaagaccccattttctttcttgagtcgtttattttcatcaactagagaagtgtattcggacgatgataaagtggatgatgatctttgatcttcttcaaactcttgtggtgcgacttgaattaacggtgcaataggttgttgcttgttagtccaagcttttcttcgacgaatttggcgtagtagctctctttctcccttccgaaacatgtcattgcaaaactcccaccggctcgttgcaacttttcgaaaaccctattcataacaatgacacgaaagaaacatagggaatctgtccttcgactcaaagaaggcaaaacaaaacgtgcctcaacaaaatgacaaaa

SEQ ID NO: 17417 - DNA, 879 bp, Populus trichocarpa
  Predicted polypeptide sequence is orthologous to G264
ttttttttttttttttttatttaaaccaaatagatagtttcatgtcaagttatattctagatgttaccaattgtaaatttttgaaactaccgaaggtaccaggagaaacctccgcacacctctcgctaagctttaagacaattgtgatgctcatagagagagctgctccatgtttttagcatttcttggcactccgaaacctaaccttctttcatcctgctcatcataagagtttgctcggtaattagaacttgcctcttcattttcataagagcccggtctttcagttaggaactgttcccagaaaccatcattgactctagctggagctgatgcaggcacttgactgttatttgggatctcctgggaggaggataaagttgtgccctcgttacccagattcatgttctgaataactcgcatgtcagaatctttgttactctcgttaaaccttgattctggagatttgacaatttcctgacgtagtggaggcatcctagctaaataaggatttttgttgacttgcaatgcagaagatgccagagttaggttcaattgacaggaaataaggccatcaacttcttcattggaagtcaaattcgcctgcagtgaatgttgtgcttggctcccacttgctggtaagtctcttgggacagcaggattcactttaaatgtatacgatgtcccagtatccgaaagttccaatggtttcaggtgccaatagtaaacctgatgtcctagtaggtccatcttttgggattcccttcagatattttcctttgtgggcttcccccgtcttcattggagctctgcgtactacgtgaaatcaaattaatatctgaacagctggggataattccagcctcaacttatttgaga

SEQ ID NO: 17418 - DNA, 932 bp, Populus trichocarpa
  Predicted polypeptide sequence is orthologous to G268
ttttttttttttttttgcctgaatatttgtgtatatttctagatcaatatctagtaaagaataaacaatacaaatgctttcaacttgagaaagtagactgtactatggacattgattgtgttttacaacaattacatgacaaatataacggcctctctttttggcatgatgagccagttactacgttctgacatcaggatctgcacccacatggtaagtcctcaaaagacaaggggtgaagtccatgaagctcagtagcccagtggcctaatcgctacaggatcaaaataattctttctccttcaaaatccagcttttcctacccatcttttctccattatctctaagtagttgatctgatatttacaactacctccagaaaaccactgctagcttttagattgcattcattcaaggacgcaaaaggcgcttgtcacaagtcaagatcctgtaacttgcatgaggaccctcagatgtgtcgcgcgaagttgcctgccagcccatggctttagctatctgtagaagttcatccatgacatcaagagagtcacgaatgtatactcgaccaccgggtctaagtatgcgatccatctcgagcatgattgtagacatattacatcttttcctttcaacagaaaagaggccagctgcatgcaataaatcataggttcttgggtatgtatcgaatggttcacaccaatcatgcataactcccaagagcccgcggtcatataaaacaggcaaggtgttggatccgctaacaggaaccacgttcaaaacccagcaatcaaatccttgatcaattaatgcagccgcgaatcctccaaagccagctttcatgtccatcacatttctaagtttaaatttcttcccatgccaagcacggacatagccagctattgtttcggaccaaaacttattttctgccttta

SEQ ID NO: 17419 - DNA, 864 bp, Populus trichocarpa
  Predicted polypeptide sequence is orthologous to G268
ttttttttttttttttttgaatctttaatatattaattatacaaccaattatcaagttcaatctattacactatattcagtactttttaaatatcactaaagctacatccacagcctcgtggtcaaggcaaggcacgtacatagataggatcggaggacacttcttcttgataagcttgcttgcttgcccatataaaattccaaaagccaaaagccactgctggcatgcacacaccttgcttagctacctgctgcagcatacatcattcagatttcagagagagcatacacaactgagacagttgtagcctctcgtggaagctaaaacgaccccgtatacgcctcgtgccgaattcggcacgaggtgaaattagagattagagattgagtgtttgtgtatatttctacatcaaatgttagtaaagaatagataatacagctggttttgacttcagaaggtcttctgctactatagacattgtgttttgcaacaattacaccagacacgcagacagtgggctccccttcttggcaggatgaaccatgttctgatagcaggatcacaacagggcaagtcctcaaacaacaaggggtgaagtcaatgaatctcagccacccacagtcctaatcactgcaaaatcaaaacaatccttcctccttggaaatccagcctttcttagccatctttctccagtgtctctaagtggctaaggagacatcgggttgatctgatcctttacagctacctccagaaatcactgctagcttttagattacatttattcaaggacgcaaaaggcgcttgtcacatgtcaagatcctgtaacttgcatgaggaccctcagatgtgtcacgcacagttgc

SEQ ID NO: 17420 - DNA, 879 bp, Populus trichocarpa
  Predicted polypeptide sequence is orthologous to G270
ttttttttttttttttttgatcaaatgggctgccattttttatcccatcggaaatgtccttggcatatttttgtcctaggagacaattcctttatctgcatccgtccaattcctccatactacaaggtataatcttgtacacgagggagcttggagtgatagactcactgtcagagcaacaatttcctgcgaatcttggataatgggaagatacgaagtggttccgttaaagcagttgggaagctgaggcgttataaggattttttgccaaagttggtttcttcatgaactgcttcagcagcttgataagctcgtaggtccttgtgtctctaccagaagagaggcagagatcgagtggtgttgagccatccttgttttttaatgtcctgtccgctcttttaattaataaaagcttcactatgtctgttctctgggtttgaacagcaagatgtaacggtgtccatccatcattgtcctgaaggtttatatcaacgttatataacagaagaagtttgatagctggagcagatgcagtttgaactgcataatgcatcaaggtggcaccctctgcatcacgaacaaaaggatctgctgattctctcaacagatagctggttatagcttgctttttgcatactattgctctgtgaagtgcagtccaaccattcacatccgcagcattgatgtccacattgtgcttcaacaacgcatccataaggtggaattctcctgatgcagcaagggtggtggagaggtagccatttgctctgcagagaattcaacaaaaataaaaaactacaaatgaattgcagatttgcgtaatgtatattatccaaaaaaacaattgcaccatgtacagcctgtcataacttcttcaaa

SEQ ID NO: 17421 - DNA, 847 bp, Populus trichocarpa
  Predicted polypeptide sequence is orthologous to G274
gagctaatactctccctccctcccagctctgcttctttacccccacggtcacactgggacactgaaaccgagttcaagcactgtggagatctagagtgtgtgtgtgtgtgtgtgtgtttaagtaagctctcattgaagagctagctagattcatctttcaggggattcgcccaaacacatcatgggtaacaagcacaactctgcagggttcaaaacacgaagtccattgtctatattcattgttatctgtttgtgctgtttcttttacatcctgggtgcatggcagaagagtggttttggaaaaggagatggcatagctgtacagatgtcgaagcagacggattgtcaaatcttccctgatctgaactttgaaacccatcataatgatgttgagattattgagccttctaagccaaaagccaaagtgtttaaaccatgtgatgtcaagtatactgattatactccttgccaagaacaagatcgagccatgacatttccacgggagaatatgatataccgggaaaggcattgtcctcgtgaagaagaaaaactgcattgtcttattccagcacccaaagggtacacgactccatttccttggccaaaaggccgtgattatgtccattatgctaatgttccgcataaaagcctgactgtggagaaggctgttcagaactgggttcaatttcagggtgatgtattcaaatttcctggaggagggaccatgttccctcaaggtgcagatgcatacattgatgaacttgcatcggtgatccctatagcagatggctctgtcagaacgcactagatactggttgtggggtagccagctggggagcatacctga

SEQ ID NO: 17422 - DNA, 979 bp, Populus trichocarpa
  Predicted polypeptide sequence is orthologous to G274
gactcgaactgaacccgacagccagtctgcatcttcatgcgatccatttgcgcttatctgatctgatctgatctgtttccataccttacctctctccttcaacaagaatggcattgaaaagcagttcagctgatggcagaaccaggagttctatacagatatttatcgttgttgggttatgctgttttttttacatcttgggtgcttggcaaagaagtggctttggcaaggctgacaatcttgccatggagattactaagagtacaggagattgtaatataatcccgaatcttaattttgagacccatcacggtggcgatgctgggtccagtgatgattccgattcaaaacccaaaacttttcagccttgccattctcgttttactgattacactccttgtcaagatcagaagcgtgctatgacttttcctagggaaaacatgatttatcgagagagacactgccctcctcaggaggagaagcttcactgcttgataccagcacctcaaggttacgtcaccccatttccttggcctaagagtcgtgactatgtgccctttgctaatgcaccctataagagtttgactgtcgagaaggctattcagaattgggtccaatacgagggcaatgtatttaggtttcctggtggaggcacccagtttccacaaggagcagataaatatatcgatcagctagcttcggtgttaccatttaccaatgggacagtcagaactgcattggacactggttgtggggttgccagtttgggtgcgtacctctggagcaggaatgtcattaccatgtcatttgctccaagagattcacatgaagcgcaggttcaatttgcccttgaaagaggtgtacctgctgttattggtgtttttggttctgtaaagcttccatatccatccaaagcctttgacatggctcactgctctcgttgcttgattccatgggagctaatgatgggatgtacttg

SEQ ID NO: 17423 - DNA, 944 bp, Populus trichocarpa
  Predicted polypeptide sequence is orthologous to G274
ttttttttttttttttggcaaaatggaataaattgaatattggctgtggttaactaagaaatataatctttgattgtgaaggacgttcttcttgtcatcagtattgcattcgtgaagcttgataatttaactgatcaagccactgagttgtgcatatgctccacatcaacaataacagattaataacttaaatcagaattcttcagttcagcaatttaatcacttgcttggcattgtaattgctggcataattttgccctgaaaacaatgactaccggattattgatcacttgatgtgctgtttcctgtgccaccaacccagtactgtttaaccaccaccagtatcttctcaggtacaaggggaccatcctcatgatccatcatttttgtatcccatctcattcctccagcaattttcttaaccttgttcagaacatcaacctcatctcggaagattacggtcccttcaggacgcaaaatgcggtccatttccagaaggatgtcttccaggttacacttgttctggtacaaactaaatacaccattggcatggataaaatcatacgtccttgggtatgttgagaacccttcacaccagtcatgataaataccaactaaacctctctcgtagataacgcctaaagtattcttagcaatggttggaactacattcatcacccatgattttggggattcaagtgctgctgcaaatcctccaagccctgcattcatatccatgatgttcctgtatcttgtagtgccaatcaacttattgttccttttataagcatttatatgctttttccaaagtttattgtcctcctggaaggattcagctgtgacacccttgacaagtcccttggctactcgaggaggaattgcaaaaagcctctctggaaacttcttaaactccctcctgctacttcatttgcactgtttacttc

SEQ ID NO: 17424 - DNA, 594 bp, Populus trichocarpa
  misc_feature (42)..(42): n is a, c, g, or t
  Predicted polypeptide sequence is orthologous to G274
ttttttttttttttttttgccaagaaagagatttattaatcngggaaaagaatgatgcaattggtaggtgaagctaacttatctacattctataactatctcaaatgaaagagcataactcggtaaacaaacaattctgcagaaacagcattccttggctggctggaaggtagaacaattctgcagaaacagcattccttggctggctggaagctagatgacccatgtgtagtagtaatctgtacgatctgactaggaaaggttgagctcttcctgatacaatcacccccctgatatataatccaaaaacacttgttcactgtgatgaagtgctattgttttcgcctgcaacccagtattgtttgacggtgaacaacactttttctgacggaagcggcccatcctcatgatccaccattttcgcattccatctcattcctcccacaattctcctcaccttgataagcacatcaactttatcacggaatatgactgctccttcaggccttaaaatacgatccatctctagaagaatgtcttccatattgcacttgtctttatacaagctgaaaacaccatttgcatgaataagac

SEQ ID NO: 17425 - DNA, 660 bp, Populus trichocarpa
  Predicted polypeptide sequence is orthologous to G275, G837
aggaaactcaacagtcttctaaccagcaaaaggggtacaattggaaactgtgcaatgtcactgctgggcctgatttcatcccatgtcttgacaatttgcaagcaatcaggagtcttcaatctacaaagcactatgaacatcgagagaggcactgtcctgaagaacctccaacctgtcttgttctgcttcctgaaggatataaacggccaattgagtggcctacaagcagggaaaagatatggtaccacaatgttccccacacccagcttgcacaatataaggggcatcaaaactgggtgaaagttacaggtgaattcctcactttccctggtggtggaacccagtttcagcatggggctctccattacatcgacttcttaaatgagtctgtgcctggcattgcatggggaaaacgaacccgtgtgattttggatgttggatgtggagttgctagctttggaggatatcttttcgacagagatgtcctagcaatgtcatttgcccctaaagatgagcatgaagctcaaatacaatttgctcttgaaagaggaatcccagctatatctgccgtgatgggaacaaagagcttccctacccaggcagagtttttgatgctgtccattgtgcacgctgtatagtaccttggcatattgaaggtgg

SEQ ID NO: 17426 - DNA, 877 bp, Populus trichocarpa
  Predicted polypeptide sequence is orthologous to G280
ggttccttcgatctccttctcttttagaaaacatttgtctgtttccatggctaccatcactgaagattctactaacccccaacctcctcctccaccaccagcagcggcaccagctccaccccaacaacagtcacagcaacaatcctccgctccccctcagtatcctgagatgattatggcggctattgaggcattgaacgagaaagaagggtcaaacaagacatcaatttcgaaacaaattgagtcaacacaccccgatctgccacctgcacatagcacactcctctcccaccatttgaataagatgaagcaaagtggtcagcttgttttggtcaagaataactacatgaagcctgaccccaacgctcccccgaagagaggcagaggccgccctcccaagcctaagcttccaaccccaccaggaactgtttctggacctcccaggccacgtggccgccctcccaaaccaagggatcctttcgcgcctgtggcttcccctaagaagaagacgacaagtactggaactgggaggccgcgtggtcgtccacctaagaacgctagtacggcggttcccgctgcgagttctggtggtgctccacccagcggtgcgcggagaggaagggggaggccgcctaaggcgaagccagccgtggcacccgtcgctggctgagtggaattagagcaagggagagaggagagataggaatcagtttctttaatcttttttttttcctttttaactttttttcttttaggtagacaagggaactactaattgatgttgtagcttaagctttagcgttcttcttctttttttttttctaagttttgaatttagtttcaatttaaaatgtggtgagcggtattgtaatgttga

SEQ ID NO: 17427 - DNA, 858 bp, Populus trichocarpa
  Predicted polypeptide sequence is orthologous to G280
ttttttttttttttttttaccataaagcaagaaagctcaattataacaaatacaatcatccaattatacaagaagacacgacacagttgcatgcacaaaaatacacacgatgttgccatactaataacacgcaccactgttaacaactaacacacacaattgaccaattctacagacatgttgagacaacagtccgtcgactgctactaccactaatgggaggagattattaattctgaacactcacttcaggcatagttgcggccttcacctttggaggccgaccccttggccttccactacctgccgtcattggaactgctgaggttgtggtagcagttccagtggttattcctcctgtaggtcgtgccatcttgcgtggcctccctcttggctttccacttcttccagtcgcagcctttggcttcactggctttgggggtgcattgggatcctttggtggacgacccctcggtctggcagggggcaggtctgagcccggtgacaatgggtctttcggcttagggggcctaccacgaccacgcctaggaggagcattgggatctggcttcatgtagttgtttttccaaaatactaactctccggtatccttcattcgattgaggtggtgtgagaggagtgcagtgtggccagctggcaagtccccatattttgattcgatgtatttcgatattgacgtcttgttacagccattggcctcattcaatgcttcaatggctgacaaaatcatctcagggtaaggagggagtgatgggggcttattaatctcctcagctgccattaaatttccaacaaaataagagagagaaagtttgaaactttaatgtccaaactctt

SEQ ID NO: 17428 - DNA, 824 bp, Populus trichocarpa
  Predicted polypeptide sequence is orthologous to G280
ttttttttttttttttttctttttttttttttttaacagctaaaatcatccaattatacaagaagacaagacgcagttacatgcacagaaacacacaccactgttaagaactaagaacacgcacaactgcccaattctacggatatgtagaaacaacatagtccatcaattgttattaccactaatggaaggagatgcctaattctgaacactcacttcagtcatagcagcagccttcacctttggaggccgaccccttggccttccactacctgttgtcattggaactgctgaggtagctgtaggtgttccggttattcctccggtgggtcgtgccatcttgcgtggcctccctcttggctttccacttcccgcagtggtagccttcggcttcactggctttggtggtgcatttggatcctttggtggacgacccctcggtctggcgggggccaggtctgcgggtggtgcaagtggatccttgggctttgggggcctaccacgaccacgccttggaggagcattgggatctggcttcatgtagttgtttttcaaaaacattaactctccggtatccgtcattcgattgaggtggtgtgcgaggagagctgtgtggccagccggcaagttcccgtgttttgattcaatgtatttcgatattgatgtcttgttagagccacccgtctcattcaatgctgcaatggctgaccaaatcatctcagggtaaggagggagtgatggaggcttactaatctcctcagctgccattaaattcccaacaaaatcgagaaaaagtttgaaactttaaagtccacgctcttcac

SEQ ID NO: 17429 - DNA, 906 bp, Populus trichocarpa
  Predicted polypeptide sequence is orthologous to G291
gcttcttcttccatagccaaaaagacctgggaactcgaaaacaacataatacctatcgacacagcaaccccgacaacaacagacacttcttcttcttcttcttcatcggacgcgattttttacttcgatgaagcagcacaagcaaagttccagaaagaaaaaccgtggtctaatgatccgaattattttagaagagtgaagatatctgcacttgcgttgttgaagatggttgtacatgctcgatcaggtgggactattgaagttatgggattaatgcaagggaaaactgatggggattctataattgttatggatgcctttgctcttcctgttgaagggactgagacgagagttaatgctcaagctgatgcttatgagtatatggttgattattctcagactaataaacaggctggacgtttggagaatgtaattgggtggtatcattcacatcctggctatggatgctggctttcgggtattgatgtttcaacccaaatgcttaaccagcaatttcaggagccgtttttggcagttgttattgatccaacaagaactgtctcagctgggaaagtagagattggggcattcaggacatatccagaaggatacaaacctccagatgatcctgtttctgaatatcaaactattcctcttaataagatcgaagactttggagtccattgcaaacagtattattctttggacatcacatatttcaagtcttctcttgattgtcacctcttggatcttttgtggaacaaatactgggtgaatacgctttcatcttcacctctcttgggtaatggagactatgttgcaggacaaatttctgatttagctgagaagctggagcatgcagagaatcaattggcacattctcgattgggacattaatgactcctc

SEQ ID NO: 17430 - DNA, 722 bp, Populus trichocarpa
  Predicted polypeptide sequence is orthologous to G307, G308, G309
ttttttttttttttttttattttttttttttttttttttttttaaataaatacaacttttgattcatcctgaaaaacgcagaagattccacccaaaaaacaagaggaaaaaaagacttgaaatgaaaatacctaagggaacagctggcgattttttttttaagaaaaaaaaatgacaaaggaaaagaaaagaatactgctactaattaacaaaaggtgatccagagacaagcggggtaagtgatggggtctcactttaactccggagcagctcagcatatcacacagaaccgcactagggtttggattgtgtggggttcgaaaaggagttgacctaactcggacgagtagactcagtatgttttgactctctaagcagcaccaactaccggttggttggtgttgagccgccaagcaaaggtggctatgagcgggcgtgtgtgccagcccaacatcaaacacccattattctcctccactctgtacccgtctccaccagcaaacagggccaacaacatgctggattgcttaaacgcgttggaaccgagatgaaccggagcaaacccaaccgaacccaaccgagttcgccactgtgtcagggtctcatgcctctcaactcggtcaggcccttcgcatgccacaacattgcaaatctgcttccccaagtacacctctgacattatcttatcttgggtactcacagatccctccagcgaatcaaac

SEQ ID NO: 17431 - DNA, 874 bp, Populus trichocarpa
  Predicted polypeptide sequence is orthologous to G307, G308, G309
gcacacccgtctttggtttttgagcacaccacccccacacccaaaaatctcactctcataatagaaattccctagaaagaagaatgaaaagagaacacccaaatctccatccccaacaaatctcagacccatctactcttgctgcagctgggtattctacttctaccagtgccatggcacctcataacgggaaagctaagatatgggaggaaggagaggggcatcaagcagatggggggatggacgagcttttagctgttttgggttacaaagtaagatcgtcagacatggctgaggttgcccaaaaactcgaacaacttgaagaagtcatgggtcacgcgcaagaagatggtctttcccacctcgcatctgattctgttcattacaatccttccgatctgtctacctggcttgaaagcatgatttcggagttgaacccaaatctcaatttcgacccctctgctgattctttacttgctcctgctgaatcttccaccatcacttctatcgatttctccgaccacaaacatcatcagcaacaaaagctgttcgaggaatcatcatcatcggattatgatctgaaagtcataccaggtaaggctgtcttttctcagacccaaatagactctagagaatctaaacgcttaaaaacagacctataccagacatcctcttcgtcatcattgtcttccgctactacccttggttcttttgggattttcgaccgagtcgactcgtccggtggtcctagttgactcgcaagaaaacggtattcgtctcgtccatctctttatggcctgtgccgaagccgttcaagaagtaactttaccctggcagaagcgctcgtcaaacaaatcggctttttagctgtttc

SEQ ID NO: 17432 - DNA, 811 bp, Populus trichocarpa
  Predicted polypeptide sequence is orthologous to G307, G308, G309
gattagaatgaaagaagcatgaaaagagaacactcaaatctccatcctcaacaacttactaacccatcttctcttgccgcaggtgggtattctcttactagcaccggtactatgacttctaataacgggaaagctaagacgtgggaggaagagaagggacgtcaagcagatggcgggatggatgaacttttagctgttttgggttacaaagtaaagtcatcagacatggctgaggttgcccaaaaacttgaacagcttgaagaagtgatgggtcatgcacaagaagatggtctttcccatcttgcatctgattctgttcactacaatccttccgatctgtctacttggcttgaaagcatgctttctgagttaaacccaaatcaccatttcgatctttctgctgattctttacctgctcctgctgaatcttccaccgtcacttccatcgatttcaccgaccgcaaacatcatcagcaaccaaagctgttcgaggaatcttcatcatcggaatatgatctgaaagtcataccaggtaaggctgtcttctctccaacccagatcgactctagagaatctaaacgcttaaaaacagacctatatcaaacatcctcttcgccatcctcgtcctccacaactctcggttctcttgtggcttcgaccgagtcaactcgcccggtagtcctggttgactcacaagaaaacggtgttcgtctcgtccatctcttaatggcctgtgccgaagccgtccaagaaaacaacttaaatctggcggaagccctcgtcaaacaaatcggctttttagctgtttctc

SEQ ID NO: 17433 - DNA, 875 bp, Populus trichocarpa
  Predicted polypeptide sequence is orthologous to G312
ttttttttttttttttttcaactaaaactcaaaagattgaaatttatataaaagagttacaaacacctaagagaaagaaacttttcctttcacttgttttttacaatttgtgagactcaagaacttcaaacctataacaaaaagccaacagaatacaaaaggaaaccatatatctaaatgaccaaactgaaagactacaactagttacaggcttcaatggacctgtcaatgcacaattgcaataaaaaaaaaaactaattacccttccagttcgtgatctgatcaagaagcaccccccaacaatcccattcgatggcgtataatacaaactagaacattgttccacaccagagaaaaattaccaggtggaaacttaaatcaaattcaagtccagccccatcgattatcgccatgacgaaactgtgagtagtggcacctcattccaagctaaagttaagaacccaggctgagaatcatcaagagaatacaaatcactgtaattgcaataccataagagtatcttagcctgactcattgcataatggctaagcgaaaccgattcaaaacctgaactttccattaaaactccccattgatctttatcctccatcctttcccttctcattccaggctcctctggccctacaacactagaaattctctgacccaataacaacctctcaacttgaagcctctctggtgagtctctactcaagttaggctcaagagactcaaaaacagcagtgtagtatctcaaagcattcttaaaccgagtcaagtacccaacccggttcaaactagcttcatattcaccaagagtgacaattatcgggttcaacgatttagccatctttaaagcagtttctacagcaact

SEQ ID NO: 17434 - DNA, 858 bp, Populus trichocarpa
  Predicted polypeptide sequence is orthologous to G314, G2699
ttttttttttttttttttctgaacctgctgtaaatcagatatcatttattaaggaaaaataacagcaatgttgattaagaaagggcgtagctaggtactagcaagttactttcaacttcctgaaacaaaaggacgggggaacaaggtggtggaggaatttgtctcatacaaagactacgtacatttctctctttgccttccatgtgctcatacctagagagcaaatacataggtaaatattaggtcattctcataacactgctgataccctacttgcctgtgcccatttgcagactcttggcaaagagagaggcaattttattttgtcattgcatcttcatctagaccatcttaaatgaagggaaaagaaaaatcagccccatcacaatcttgcccgaaattatctagccacttatgtcacatttctttgtcatttatcatcaagtccagacccaattaatcctgcaaatcaattgggacccaagctgtggcaaaaactgagttgtgacccttccatgtgagcattaacatgtgatcttctcctcttttcatgccccaaccactagcatgctcttctagcaagcatctaacttcaccaattgtgtcttcacagaatggaacactaaaaaatcctgcattcttcatcctttctgatactttaatcccgggttctaacctctctatcctctgaagcccttcaaaactgataatattctcgattttgtgaccaatatcggactcatattcaatcctttggctactatctttaggcaagaaagtttccaaagcatcgaatggtatccatagataattgaagcaagtagtaatcctagatgagagacttggtgcacttaaatc

SEQ ID NO: 17435 - DNA, 797 bp, Populus trichocarpa
  Predicted polypeptide sequence is orthologous to G343
gaaaacatattgattatgcatgaacacattgacattaattcaaagctatttagatagcaataaccccatgtaaaagtgatattattctcttgaaaaataaaagactaattactctgtagatgtttcaattgttaaagttcagctctttacactttctaactcatagcaacctaaaaaaaaataaaaaaaaataaaagagtttttaaacaacgccatcaatttctacaccaactttctttattgtgaccgttaaggttgttgtattggaatcgatcacttgcagagcaaatccatttccgtccgagtagagctgccatcataaataacagttgaaactttaaaaccaaaattatgttagaaatgattaagttcaagatccaattaccaacaactgacaacactagagtattttctttctcaattcttttaagttttaacaatagaaaggagcttgataaaataaccagcagttactaccctacagatttcaagccgctgagatcatgacacgttagcaaacttcatagccttggtaaccgtgctgctgctgctgctgctgccgccccaccgtcatctctttctgtcttcggagctccaaaactttacggtgcgagttcgaatgccgagtcaacacaaaagtcggactcgctgcgggtcgatattctggtacaagccgacccgacttatacctgactccacaggcattgcatagcgtttttggacccagcggacccgtcctccactgaggagtcttctcagacgcgcagtgcgtgcacctccgcactgtcccctcctcc

SEQ ID NO: 17436 - DNA, 850 bp, Populus trichocarpa
  Predicted polypeptide sequence is orthologous to G346
tctcttaccttcaaaacaccaaaacctctctctctctctagaaaataaaccaccaaataaacaacccttgtgggtttcttcttcttcttcaaagaaatggagtctctagacacggctgctggtttcatggttgatgaccttttggacttctgttctgatataggcgagggagatgatgacgaagaacaccagaacaacaacaaaaaacccagaaagggacttccttcccttaaccctaatgcccttgcctcggcttctttcaacgttttggaacatactttgttacctgaatttgcagaggaagaactggaatggttatcaaataaagatgctttcccagcagtggaaacctgcttcggcattctctccgaggagccaggcagcattcccaagcaccacagcccagtctccgttcttgaaaacagtaccactagcagcactagcatcagtgggaatagcagtaatagtagcattattatgagttactgtagccttcgcgtgcctgtcaaggctcgcagcaagcgtcgccacaggcgccctcgagaaatccgagagcaagagcgctggtggagtcgggaaaattctacaaggagaaaaccagctgtgtcagtagcaaaaatggggagaaaatgtcagcattgtggtgttgaaaagaccccgcaatggcgggcaggtccagatgggcctaaaacgttgtgtaatgcttgcggggtgcgatacaagtctggtaggttggtgcctgagtatcggcctgcgaatagtccgacattctccagcaaattgcactcgaattcacatcggaaggttgtggagatgaggaagcagaagcagatgatggggtcacttgttg

SEQ ID NO: 17437 - DNA, 900 bp, Populus trichocarpa
  Predicted polypeptide sequence is orthologous to G351, G545
gtttgtttcttactctcttcgctttcaaaagaattcaatatcatcaagaatcccaattatggctcttgaagctctgaactctcctacaacagccactcctttcaattatgaagacacatgtgttaaaaggaaacgctccaagagatctcgtagtgagtccccttcaacggaggaagaataccttgctctttgccttatcatgctcgctcgtggcggctccaccacctccactaccacagccaacaaagccagtcataggaaatcctcctctgagtccaccacagccgccgagaacccctcaacctccaccacacctgcaactaccaccaacaccagtggcaggacccatgagtgctctatctgccacaaaactttccctaccggccaggccttaggtgggcacaaacgttgtcattatgaaggtactattggaggcaacaacaacagcagtactagtgctgcaatcaccacctcagacagtggtgctgtcggaggcggcggcgtaagccagagtcaaagtcaaagaagcggtggtggatttgactttgacctgaacttgcccgctttgcctgaatttgaaggtccaagaatcggtcaccaagcactattaagagatcaagaagtggagagtcctttgtcagggaaaaagccaagattaacgctatcgcttcagaaagaaaagaccggcgtggtttctttgtaaaactgaatttttagaattgtagattaggttcaattaggaagattgttggatttctttgttttaaataagcgctattatttgttcttatcttttagggtttgctttgatgatgagttggttctgtaaagagaatttcttcatcgtttgtagccttcctacgctactggacaaaaaaaaaaagaaaaaaaaaaaaaaaa

SEQ ID NO: 17438 - DNA, 669 bp, Populus trichocarpa
  Predicted polypeptide sequence is orthologous to G351, G545
ttcgaatttcaagtattacaactgaaatatccaacttctatgcacaaaaaaattaattaaataaataaaaaagtccaaacaatggaataaatctctaaattgatatcacctaacacagcctaacagaggttctaatttttctactgagcttgggagacttcaaatcttggtggcgtcgaaatacgaagctttttcgctgccggtagagggctcataacctcatcttcaccagatacagagaaacatgaagagaactctggcaaggcaggaatattgaggtcaaattcgttgtggctatgagtgcgagtgttggtagatccagcactttcagaagttgaagtgacaccactcttttcgccgcctcctatgatgccttcatagtgacacctcttgtgaccacccaaggcctgtccagtgggaaaagtcttgtggcagatggagcactcgtgagtcttaccgcttccgttagatacggtttttgttgctgttatggcagaagtagttgtactggaagtagtttggtcttcgccgcctccagcgagttttctgtgacttgccttgtgaccgcctagggcttggtatgaaggaaactccttgttgcatacggaacacttgtaactattttttagctctgaacatgttaatactgttgatggggtgagggacttc

SEQ ID NO: 17439 - DNA, 619 bp, Populus trichocarpa
  Predicted polypeptide sequence is orthologous to G351, G545
gccgccgaaaacccatcaacctccaccacaactaacacaaccaccacgaccaccaatggtaggactcatgagtgctctatctgccacaagactttcctaactggacaggccttaggcggacacaaacgttgtcactatgaaggcacaattggaggcaacaacagcagtagtgctagcgctgcaatcaccacctcagacggtggtgctgttggaggcggtggcgtgatccagagtaaaagtcaaagaagcggtggtgggtttgactttgacctgaacttgcctgctttgcctgaatttgaaggtccaagaatcagtctacaagcactctgcggtgatcaagaagtggaaagtcctttgccagggaaaaagccaagattaatgttttcgcttaagcaagaaaagaccgatatgggttcttcgtaatttgaatttagaatttaagattaggtttaattaggaagattcttggattttcttttcttttcatcactcttctatggtgttgtcttttggtgtttgctttgataatgaattggttctgtatagggattgtcttcattgtttgtagacttcctctgctattctaccattggacattaatttaaaaaaaaaaaaaaaa

SEQ ID NO: 17440 - DNA, 788 bp, Populus trichocarpa
  Predicted polypeptide sequence is orthologous to G353, G354, G2839
ttttttttttttttttttgatacctttatctagcttcttatttcatgtatatgaacaaattaacttaatataaatacaagatgtatagcgagtgttcctaaatccaggaagaacgaaaggaaaggggaaaaaacctagctataggtatagtttcatgcgattacacatgtaagatctaaaagaaacaattgaccataggagctgtcgttccgagcttaaacaactccatatcattctcataaggagtcaaattcaaatccaaacacaaaaccctcctgctattagatctcttcacgacaggaactgctttttgatcatcagtgctaggagggttcagaggatccacctggtttcgatcattcaaggcagctctatgtctcctcatgtgaccacccaaagcttgtccaatagcaaactctagtccgcaaatagagcactcgtgcgttttaggctttgctggcgattgagtctcgaagctcccttctcctcccatcaaccttggcttcttgtgacttgcacggtgaccacctagggcttgaaacgatgggaattgcctattgcatgttttgcactcaaaaacacgagcaggagaaatattgctcatggcatgatcaaatgaaggaaaagaatatgattcccttcctttagatagaaacatcaagcaattagccatggttatgctatcaatctctctctcatgcagacctctcttcatggtataagaatatgaacaataagggttttgttatcctttggtttcaaatgtgaaaaggatgttggatttgctc

SEQ ID NO: 17441 - DNA, 575 bp, Populus trichocarpa
  Predicted polypeptide sequence is orthologous to G355
ttttttttttttttttttcgaaaagaacaattattttataaagagtccactccactaatataaatcgatgataccagaattttacaggaaaaaaaatagaaatacaacaaaacaaataaatgaatgtgattcgtacaaaatcccaactacatagtagcagaagttggtaataaggagagaaaaaaatatgtccaagctccaaattaggttagataaaacatctcaacatgggacgagcgaccttctctaactgcaactccgagtcattctgatacataggcagggccaagctcaaatccaagcacagaactctcttgctgctattggatctcttcaaaactgggacagcgggtaagaaaggcggctgagtcacagctgccaattcatgatctttactaccagtactggtggtatcaacattatgaggcgcccgatgtctcctcatgtgacctccaagtgcttgcccgagaggaaattcaaggccgcaaatggagcactggtgagtttttggctttgaaggcgaattaggcagcttcaacaagttcccagttgattccatgagttttggtttcttc

SEQ ID NO: 17442 - DNA, 911 bp, Populus trichocarpa
  Predicted polypeptide sequence is orthologous to G359
tccgtgctgctaataaggtaaattctctctcttcttctttgatgaagttaatgtgagatactttggttttaatcgaaactaattggttattgtctagaattagattgtgggtttggtttcgctggttctgctggctttgtttttagtttctttatgttattttggaagaactcgtcttttctttcttcctttccttttttcctgctaatatataaaaaaagaaggatttttttaatgtttgatttgaattcataattataaaaagtggtgaagaattagctcataaatggtaggaattggattgacttgaacttaattcttgaaaaaaatgttatcaattggcgcatgaagtaaggtgtttttcagtagaagcaatgtagctgcaagtcccaaaagattctcgaagatattaagctttggggtttcttaagaggtgaggacggggggcctaggttgaaaaggaaaaggttcgaatgataatcaagatcagtttgtgtctgttgcttgttattatattgactatttttatatgggaatatatagcttctttgtttttgtttcattacttcatgcttcataataattatgttttatgatgtgaatcactttcgttcaatctctcattacttgtgttttctttttctttcttttttccttttgttttttggttggatgtactgatccggatagatatttaaactattaaactggctgttgtttcttgggccagtgccaatatctaaatttcaagaaattcatcacttcattttaagtatttttttcatctgtcgaacatcatcatcatcgatcattatcctctctttgtcattccttcttctctcttgcctgacgctggagctatttgctaatttttcgtgagcccttaattgagtatcattcgcataaaactc

SEQ ID NO: 17443 - DNA, 701 bp, Populus trichocarpa
  Predicted polypeptide sequence is orthologous to G361
ttttttttttttttttttgactcttaaaaaaatgatcagggaagtttttttccagactcttaactccctgccaaaaaaaatcagcagaacatgaaatatgtctcacaatttagatacacaagccttgatttatcaaatataacaatccataattcataattaaacataataaaaaaaactaacataatattttattaaatgtaaactaaattcataataattcttaaaatattaaagcatacattctaactacatctaaaaattaccccagctcgtgggcgggtgtggagcacttcaagttgtaaatgagcttatagcgcctgtataagggttaataccaaaatcactttagctcatggacaagtctggatcgctcgtggataaatatgcttcctatctcctctaagtgttgaatgtgggtgatggtaatagatagcggcggtggcagctgaaacttggtgagagaatggcaagtggagagaggaaggctcgtcacattagagagagtgagggagagggtggtctcgtggtggctcagagagtgtttcataatggggagagaaggtggtggttatgggcagtgacaagttcacgtggacggtggttgtggggagtgaaggagagaaaaaataaagagaaaagggtagaaagtagatctaaggttgtagttcaattgaaatgacaatcctcacatacgactc

SEQ ID NO: 17444 - DNA, 589 bp, Populus trichocarpa
  Predicted polypeptide sequence is orthologous to G363
ggagaacattagctaagcgtgcaataagaatgggtattttctcggaaaggtatgccagcctagcatcgttgcctctacatggatcctcattccgatccctagggatagaggcacattcttcagtgcaccaaaactttgcaccaccagtaaggtcactagaaataagcagcagtgcaagatttgatcaaggttatgcaggtctgccagtattcatggaggatgatgaggcagagttgttatggccaggtagttttcgacaggtagctgtgtcagacgatgctcatcaaagttttgtagtcgcaggaagttcaaacatgatttttttgggggcaactccaccagtgaacttagatgattctgcgccagatctcacactaaaactttgagaacattggttgcagtatttatgctccgatattatctcttgtatagcaagttgtgcaatggaccatggctgaacttttatattccctgttaagaatttgtatgtcagtgtataagagcttcacagagattattctggagcttcttcgtttgttatatctatgtgattgatccttttaatttgctgaaaaaaaaaaaaaaaaaa

SEQ ID NO: 17445 - DNA, 885 bp, Populus trichocarpa
  Predicted polypeptide sequence is orthologous to G363
gctcttatacactgacatacattctcagccatggtccattgcacagcttgttatacaagagatgatatcggaacaggaaaactgcaaccaaagtcctgaaagtcttaaagttttagtgtgagatctggggcagaatcgtccgagttcaccgatggagttgcccccaaaaaattcatgttcgagcttcgtgcaagtacaaaactttgatgagcgtcatctgccacagctacctgtcgaaaactacctggccataccaactctgcctcttcatcctccataaatattggcagacccacgtatccatgatcaaatcttgcactgctacttatgtcttgtggccttaatggttgtgcaaaactttggtgaactgaagaatgtgccttgattcccagagatcgaaatgaggatccatgcagaggcaaagatgctaggctggcatacctttccgagaaaatacccattcttattgcacgctttgctaatgtcctttctctcttgtgagcattttggtgtccaccaagtgcttgagagctgaagaatttgcgctgacagtaattgcaagaaaaaactcgtggtattgcttcagctgtagtgcgcgatgcaggatcgttgctactttcgcttgtgcttgacaatgagagtcccatcgagtcccttccccctaactcatcatcattgaagcaaagttttaagtcgagagaaaccgtttctgaaccggattgagttgctatggcatttttgagataagaagagttagtgaggctttcattggagggacctgcagaagtttcttggtttgataagttggaagccacttggctgctaacatcagaaacattttctgatgatgcctcaacttcaagatcaataataggtttcatcttt

SEQ ID NO: 17446 - DNA, 341 bp, Populus trichocarpa
  Predicted polypeptide sequence is orthologous to G370
ttttttttttttttttttgaatcatcaataacttattatcatttcaaaacacatggatcatcacacaccatcgccaccatctaccatctatacatacatcccatcatcccaccatgaccatcaccaacattaatctcacaaaccacaagttacaacaacaagaggagcgggcctaaccaggctaaaaacagggcagttaaaccaacattaataccacaactatcttaattgccactgactagcaataacaacacccatttctaaagaaaatatcttattctgcaaatctcagactcttctccctcgttgtaaacaaggaagagaagtacttgagtttgacc

SEQ ID NO: 17447 - DNA, 893 bp, Populus trichocarpa
  Predicted polypeptide sequence is orthologous to G374
gaacgaccttgccctatacattccttctcgtaccttcccttcgtttagattctacagaagtttggttctttgctgctttcttcttcagctttatcttgtgtttcactgcaaacaagagagagagagagagagttgcttaagttaataataacagagaaaaaatggaaggcagagataacaaggagcaaatagtggacgtgagatcagttgttgaagctatctctacagcagataataatgacattaatgtccctctttatgaagttgaaagtctctgtatgcgttgtcgtgaaaatggaaccacaaggtttttgttgacattaattccacattttagaaaggtattgtagtccttttgatttgctacctataaggatcaattctggtttttgtttgtgagggttttgctttagaagttctagttttggttgtgttaattattaatgagcctaacttaattttgtgcttgcagatattgttatctgcctttgaatgcccacattgtggtgagaggaacaatgaagttcagtttgccggtgaaattcagccgcgcgggtgttgttattctttagatatcccatcaggcgatcaaaagattcttaatcgacaagttgtaaaatctgagtctgcgacgataaagattcctgaattggattttgagattcctccagaggcacaacgtggcagtttgtcaacgattgaagggattttggtacgggctgctgatgaattgcaggcactccaagaagaacgcaagaaagtggatccaaagactgctgaagcaatagaccagttcttgttgaaattgagagcttgtgcagctggggattcatcattcaaattcatcctggatgatcctgctgggaacagcttcattgagaacctgtttgctc

SEQ ID NO: 17448 - DNA, 826 bp, Populus trichocarpa
  Predicted polypeptide sequence is orthologous to G374
ttttttttttttttttttgccaaaaaacagcactttatttaaatgaaccagacaggcagttcatatcatacagtatccgaccttcagaaaactgtgaattgtacacaccacaagcagtcctaacacattgttgcacaactttagactctaaaaacactcttctcagcatcgcctctctcctcctactccccatgatgagagagagagaaagagagagaaagagagaggggcatggcgattgaacataacaatttactctctcgttttctcttttatcgttgtctgtgctgagtcgtaggcagcatcagctgaagatgtgtcaatatcgttcaatcccaactcctcattctgttcccaggacctctcgtattcctcatatgataactgatggtcatctttgatattgtcagtagctggggctataaaagaatttgccaatgcatcatcaagaatcaaagtccaaggttcttccacatttagaagcttgtttaaccttaatttaaagtcctgccacttgctttttttggatccatcaaggctatctccaaaagtaaatccatgaattctctcaatactttcactaatttttgtgaccagaccttcaacagttgtaacaatgccacccaaagtcccactagccagctccaagtcaagctctgggactttcacacctgcagtatctgactttatcacatcacggcttaggtcatttgcattcttcacacacaaagtgattgtctttcctttttcaggaattcgaccgccaggcttcaactcagaatttcggtaaccacaggaatcacaagtagatgccatgacaattact

SEQ ID NO: 17449 - DNA, 853 bp, Populus trichocarpa
  Predicted polypeptide sequence is orthologous to G380
ttttttttttttttttttgaaaaaatgactcccgacttgccaagacaatgagggcaaccagaataggtgggtgtatggcagcgctcaccatccagtaaccaaaatatgagataaattccagggccacgcctctcacgttttcctcgtacaaccgtgtaccaaccgtgtgtaatggcctgacatctttaccctttctcatgtagcaagtcctgttgttttgcagatggggcaccaattcttgtgcatcagccactgcttaacacaccccgcgtggaaatcatgtccgcagtccagtgttccaagatcttctccatcattgtattcctcctggcaaatgcagcatggttcagcctccaccttcgctccaacagcaacagagtatttctgctgttttaagttgtttactatagtttcttcgctcaatccagtactgacatttccaatgcgctcttccaaagccagcaactcctcataagacatgttatcaacatcaagccgcatatccctatgcctatcatacatgtcagctgctccaaacaaaactgattggtcaagaatcataacatcctcaaatcgcaagctttcacccctacgcatgagatccaagacattgcgaatctgctcggagacaacaagcctgcttcttccttcactggacaaagctcgcagaggataaggaattcccagtacaccatcaccttgtctctccaaccatgatgctgatcttggatgtggtcgatgaagaccctggttaccagctccagatgaaggcactgtatcttctgagctggaagcaccagaatggaatggggaatgagtactgctctggcctccagtatcagcagcagcagca

SEQ ID NO: 17450 - DNA, 846 bp, Populus trichocarpa
  Predicted polypeptide sequence is orthologous to G384, G385
ttttttttttttttttttttacaaaagaagtctgtctattccaaaagttcttaagatgggaaagagtagaaaagcagaaaccattgtctactagtgggtgtgagcttttcacccactagtgctccaagatacaaacaaaataacaagtggaggagaagtacggagaggtctcacaagcctaaaaaaaccctaacaactaagttaagaagaaggggaaaagtagtagatcaacctcggaatattacaaggggtctggtctatatttgccctttactttgtttggcgaagtcaattcccgaacctctaacatcttttctcactcatggtatgctttggttcttaattattcttgcccaaaacgaaagccacgaggcaaaaaagaattatgtgaggtgcgttcttgacttctcccattcttctatcacccaaaatcgaaaccaactttgagttttttcacaaaatttccctcgtttttccttctctggtaatgaactataaattaaccttcaaagatcatgcagattcgcatgataaggaagccttaatcctctccacagtgcatgcaatcaagttgttaacagttgcaactgagccaagagacagttttgctgtaggaactgaatcaaccagaatctggaacgcgacagttagaagagatcctcctgtagacccagattcatccatgcctactccatgcgctgcggttccatcaggaaaaaatagcaaaccctgatgggagaagtgccacataatctggatccccgccgttagcaccacgttcattgcacaatatcacaggagcatagattcgaaagaggccgtttgatcagtgcactctcttgcaaa

SEQ ID NO: 17451 - DNA, 801 bp, Populus trichocarpa
  Predicted polypeptide sequence is orthologous to G384
ttttttttttttttttttatcaattaagtaggagttcacagacgatacatatacaaattttgcatctatgagaagcttttttctcttggatttttcttacctataccaacttctttcttgttagatagaagatctaatgatttttgagttgcataaagaacaagaaggtaataaccttaaattctatcttcacatctgtaatgattataaagattaataataataaaaaaaaaaaaaaaggagccttgtcaaataaatccatttttctggccaagaattgtgatcctcagtcaagtttgacatcaagagggataaaccattgctggttttgaaaaacagatgaaaaactacattattggttgaaaaacaagtttacggtctagattagataagaaaagatttaattggctattgtttggattcataaagtggtctggcctcattcatttgggagtgttgaaagaaaaatatcctgaattaggtagatttatgatggatccattccataggctgaaaaaatggtttttctcccttttcactcttcagaaatcttcctatgtaggcagccatagttttgaaacccaacccggtggtcgacccggtttaatgatcgcatcacgggtcagatgggttgacccgggtcaacccaaaaaaaacaattataatactttaagtgaccgtaaaatctattaccttatcactctctgcttcaaagttatcttcttgtcaacaaccatcaagcctccacttcaaattcttcactatctcttaaatctagcaccaaatctcaaaaaactttaa

SEQ ID NO: 17452 - DNA, 893 bp, Populus trichocarpa
  Predicted polypeptide sequence is orthologous to G386, G707
gccgttgacactccggccatgcacgtagtgatgaacggtggtgattcggcttacgtggcgcttcttccgtcagggtttgctatcgtaccggatgggcctggttcacgtgaccccccatcgactaatggcggcccgactgctaataatgtcggtggccaagagagggtgagtgggtcccttttgacggtggccttccaaatattggtgaatagtctacctacggcgaagcttacagtagaatctgtggagacagtcaacaaccttatttcatgcactgtccaaaagatcaaggctgctctccaatgtgaaagctgattatgcaatgcatgattgagctgtccaattagtgagtatttgttagtttataaattttatcatggctgtgttggtctgttaattttatggcgtcagagagatagagagagcgctcgcttggtaaatgagtggggagactggaaaaacaaaagtgagttgtcttcttgttgatgtttgtgggtgttgagtcaagaacgaaccgcgcgtggtaactccttgcatggtggtgaggatttatgggccagtgactgctagccgggttgcagttggtatgcatattgcaaagagtgctcttaacacgaggcaagggtggtggttcgggcattgactcggtcgacctctgcctcaattactattactgaaaaaagagttaaaaccaacagtgttttaagaaagaaaaaatgggtctttctgatatttaaattaatatacagattatatatatataatctgtttttgttgaacttggaatgactagttcagcttgttgatgttttgtaactcgtggggttttgtattgttatgatattctaagtttactaataataacccccttttttggttgaaaaaaaaaaaaa

SEQ ID NO: 17453 - DNA, 725 bp, Populus trichocarpa
  Predicted polypeptide sequence is orthologous to G386, G707
ttttttttttttttttttagtaaacttcgaatatcagatttaatacaaaatcccacaagttaacaaacatcaacaaactgaaccagtgtccttacaagttcaacaaaagcatctgacaaaaaaaaaaaaggcaataaaaaggaggatattaaattaataaatatcaaaagacccctttttttttcttgaacatttttgtttttgttttttgtactgctaataattcagccaggggtcgaacttgagtcaatacccgaaccagcacccttgccttgtgccaaggactttgtttgctgcatgcatgccactgcacccaagcagagccagtagtcacagtcacagacccataagtcctcaccgccttgcaaggagtctccacgcgcggttcgttcttgactcaacacccgcaaacatcaacatcaagactagtcacgttttttgtttttcccagtctttaccacactcatttaccaaggcgcgcgctctctctccctcccttttaacaccaaccacccttgacaccataaaataaacagatcaacacaccatgttaaaattaaaaactaatgaagactcactaataggatgaagctcaatcatgcaaaatattcggatgacgatcagctttcacactgcagagctgccttgatcttctggacagtgcatgaaatgaggttgttgactgtctccaccgattctaccgtgagcttggctgtaggaagacc

SEQ ID NO: 17454 - DNA, 327 bp, Populus trichocarpa
  Predicted polypeptide sequence is orthologous to G388
tttttttccgttgtaaatttctaattaagaacaatacttattagaaattgggtttacagatctcgtgtcaattgcgaaatatctacttttttttttgttccaccccttccttaaaaaatttgggatgggactacctaaaaagggggaaggaaaaaagtgaatcattttcctaattcctcatcccccaatcaatccttcccgtggggtttttgccccattaaaattaaaccaaattaattatttgtgggattaaaattttgataaaattcaaaaaaccagagcgcgagccgaggtttcccagagacaccatttaaaaaaaaaaaaaaa

SEQ ID NO: 17455 - DNA, 691 bp, Populus trichocarpa
  Predicted polypeptide sequence is orthologous to G390, G391, G438
ttttttttttttttttagggcaacaaaaaacggggtcccagatgccattgctgcatcatgctcattacagtatcaaagcacttcaaagcttctgaaccagtttcagtttgttctaatctgtttactttcaggatttatgttttctccaaagtgtcacacaaaagaccagttcatgaacatgaagcaaatgcagtgagcgctttcttcttcgttcaataccttccatgccactgctctctcataggagactggccttcccatacttgacaggcagataccacctggaaggcacataaaaccctgctgcattatttgtgggaactctgagcacaatgttttccttccattatcatcaaatatcttttccaaagtgatgtcttgaagagcaaccaaagttgtctcaagcatgtcaagtccagcctgatttgaaaatgtgaaaaccggcagagtcttcaaagagcagcacactagtgcatcagagtgatgccagagtgttttaagaatagaatcacttccttcatttttaagcagtttcacacctagatagatcctgtagctttcgcatatccaacgagcaagtgtgtgcgcttcaggggttccatgtggtggccaaaaaccagcatgagaaccaaaatgagaaggggagagcgctaatgctacccgctgaacagaagctatgatactacgaaca

SEQ ID NO: 17456 - DNA, 877 bp, Populus trichocarpa
  Predicted polypeptide sequence is orthologous to G390, G391, G438
ttttttttttttttttttggagcgatagataagcttagacattcataaataaagtataaagcacattacaaagagaattgcaacagaaaaatggggccatacaaagataagggcagctaaagacggggccccaaatgccattgttgcatcgtgatcattacagtatcaaggcaccgcaaagcatctgaaccaattttagaaagacagtgtaaggagtggtctaatttgttctgtttctggagttatgttctggccaaagcgtcacacaaaagaccagttgatgaacatgaagcaaatgcagtgagcgctctcttcttcattcaataccttccatgccacagctctttcataggagacgggccttcccatacttgacaggcagataccaccttgaaggcacataaaaccctgctgcattatttgtgggaactctgagtacaatgttttccttccattatcatcaaatatcttttccaaagtgatgtcttgaagtgcaaccaaggttgtctcaagcatgtcaagtcctgcttgatttgcaaatgtaaaaaccggcagagtcttcaaagagcagcacataagtgcatctgagtgatgccagagtgttttaagaatagattcacttccttcatttttgagcagttccacacctagatagcacctgtagctttcacagatccaacgagctagtgtgtgcgcttcaggagtaccgggtggtggccgaaaaccagcatgagaaccaaaatgagaaggagagagtgctaatgctacccgctgaacagaagctataatactacgaacatactgccgagccatggatgccacattttcttgaaggtgcatctcaaatgcaaattggaatgctattgtcatcactgac

SEQ ID NO: 17457 - DNA, 867 bp, Populus trichocarpa
  Predicted polypeptide sequence is orthologous to G390, G391, G438
ttttttttttttttttttaaagcgctaaaaaagctccgctgatactggaggaaaagtatatttatatggacaaagcgaaaaactgggtgcactaaaagaaaaataattaaattaatatgatgcaaacctgcagctgggtataaatattacaaaacttatcttttcattttcaaaaatctccaccatgcctttgttgtcttcatattcaactgggagggaagatgggctgagagagatgggtgaatgaactgtggtcttcacaaaaaagaccagtttacaaaagagaaagcaatgcagtggacagtgttctcttcagcagcaagcactttccatgaaacagcttgttcatatgatacattgcgccccattgttgacatgcagattccagcaggcaagcatgcaaatccctgttgcattaactttgcgaagtctgtaaacaatgccttgcgcccagattcatcaaatatcttatccagtgtgatgtcttgcagagccactagagttgtctccagcatgtcaagtcctgcctggttagcaaagatgaacactggtagtgcctccaatgaacaacataaaattgcatccggatgatgccatagatgtttcaggacagaatctccacccacagaatcagatctcagtaattctgctcctaaatggtaacaataactttggcagatccagtgagccagtgttagagcttcaggggagcctgcagatagctttggtcccaaagctggattcaatcctgagggagatatggccgtggcaaccctctggacagatgaaatcacactgcggacatactgacgggccatggtggcaacattatcctgtagattgctctcaaacgggaactggaaagca

SEQ ID NO: 17458 - DNA, 853 bp, Populus trichocarpa
  Predicted polypeptide sequence is orthologous to G394
ttttttttttttttttttgggttggactatatatattctatttttatttatcttctatatatcctgaaccttcattaacatgctgccgaaggattagtgaaggaattatagaagtgaggctttgtagccattgaaaacgggctctttgaagccccttcaccaaccccaccaattctttcacaagatggacacatggtaagagtagctgctggcatgtgcatgtaaaagggctgtgccattttcagtgatttaaggtcttgtagctccttctgtagcctcctattctcatctgttagtgtttcacagcacttcttcaagaattcacagtccatttcagtttgcttcagttttgtcctggctctcctgttttggaaccacacttcaacttgtctcggacgtagattcaactgccttgctaaagcttgcttttgcttaggattgagggtgctgtgttgtttgaagctttcctccaaaagggcagattgctctttggtgagtctaagtttctttcttgcattagaaccatcttcatcttcgtcacttactcttgaagaaaccctctctacctctatatcttcactgctaaggtctctttccctcttaaccctaccactagagaaagaagaaacagcactatgaggagaagcttgacgatacaactgatcatgagcaccaatagactcctcacagcctttttttccatccacaaggctataagtttccgcagaaagacccaaactaagtgaaggctcaaaacctgtcattagtggcttaatctgaggctttataagccgcttgttgttatcagctggcctagatgtattctctaggtttgttgttgtgaagcctagcc

SEQ ID NO: 17459 - DNA, 890 bp, Populus trichocarpa
  Predicted polypeptide sequence is orthologous to G409
ttttttttttttttttttcgaatacaagagatgaccttcccatacaaactttttaaggaaatttagttacaacaggttctgaaagttccatctagtttaggggaaaaaaaaaaggaaaaaaaaaagggaccccagacacagccaagattacaaacggggcaaagatcatcatcatttccaattacaaccaggagaacccaccccagcaccacagatctgggctggggcgccgtgagtggatttattgctttaatgcataagaagctgcaagtaaacaagaagaataacaaacgatgatatataccaagtgtaacttagtatgaccaggaccaaaaggcatgatcttcaaaacttgcaggcgggtcagagtaatcgtcatcttcaagcttcggaaagacgtatggaggcaataagctcttgctaaagttatcttcttcatcttgtgacaaatctgattgatcgggttcgaaaacatatgaagaatctcctgcctctaagagtgaggaatgcaccccatcagcgtaatgtgggctgtctgaatcaaatatgtcgcttttggctgagctgatatcttcctgcttacaggccactgttgagattttcgacacttcaccctcggaagctgaatcagctatagcccttttaggtggctcttgcgataatgcatctttatcagacaattctgagattcccttctctttctctttgaggagcaacttgtcggtgagaagattaacctcagcttttagtttctccttctccttgaggaggttgtcatagtcagccttaaggctattgtagctagattgcaaaacgtcataatccttttccagctgtttagtcttccatcttgctcggcggttttgaaccatatagcaacctgacgcggc

SEQ ID NO: 17460 - DNA, 861 bp, Populus trichocarpa
  Predicted polypeptide sequence is orthologous to G409
ttttttttttttttttttatttccattacaagaaatgcattaccttcccaaacaaactgcaagctaaattcatttacaatcggttcggaaaagctccatctaactcaaacaaagagtaccccagcaaaaacaagattacaggaggggaaagaccatcatttccaactacaaccagaacccaacaccacatttggattgggattattgcttaatgattaacaagctgtaaacaagaagaaagacacagaaaccttgttatataccaagtgcaacttagtatgaccagcaccaaaaggcatgatcttcaaaacttgctggcgggtcagagtaatcaccatcttcaagctttggaaagacgtacggaggcaaaagactcttgctcaagttatcttcttcatcttgtgataaatccgattggtcgggctcgaagacatgtgaagaatcacctgcctctaagagtgaggaatgtaccccatccgcaaaatgtgggctgtctgaatcaaacatatcacttttggcggagctaatatctttatcagacaattctgagcttcctttctctttctctttaaggagcaactcgttggtgagaagattaacctcagcttttagtttctccttctccttgaagaggttgtcgtagtcagccttaaggccattgtagctagattgcagaacctcataatctttttcaagctgtttcgtcttccatcttgcccggcggttttgaaaccatatggcaacctgccgaggctgcaagccaagatccttcgccagctggattttcctttcgggttcaagcttgttctcaacctcaaaacttctttcaagaaactgaacttgatcaacagtaagtctcct

SEQ ID NO: 17461 - DNA, 516 bp, Populus trichocarpa
  misc_feature (29)..(29): n is a, c, g, or t
  Predicted polypeptide sequence is orthologous to G418, G965
ttttttttttttttttttgaaaataagtntggtgggggtgctataaattaagaagataattggaagagatgatgatcatcatcttcaagatactgatatgggaatagctacacctccattccctccaattctccctcactcaaagactcaccagttaatctctccaaacattaagtccaatccttcaaatcataattctatgtcccaagattaccatcaaggtattttttccttctcccatggtggtttcgacagatcctccgtatctctccaagagcataatcaacagcagcagcagcagcagcagcaacacgatatagcccaacagatccgcagagataagcatagaatccaatcagactatgaaccacccccaccggcattagtaggtattgaagaagaagaagaagaatcaagtggccttccggtctacgaaactgccggcatgttatcagaaatgttcaatttccctcctgctggtggaccagctgcggctgttgatttgttggatcagcc

SEQ ID NO: 17462 - DNA, 819 bp, Populus trichocarpa
  Predicted polypeptide sequence is orthologous to G418, G965
gtttaaacttctctgctgcccctactactgcctgctacaaaacactgctcatcttctcttctcttctcttagattctcgcacctcatgtaaatatggtatccaagcgatgctgataagcatctgttagctagacagactggtttatcgaggaatcaggtttcaaactggttcattaatgccagggttcggttgtggaaacccatggttgaagatatgtaccagcaagaatccaaagaagacgaaccaggagcagaagatagagaaaggaagcaagccaacaacaacagcaacaatagtgggcttgcacaaacaccaacgcctactacaacaacgacaggatcatcagcaccagctgccacaacaacaaccatcccatcaggcaaaagatccgaaatcaatgccaatgaaaacgacccttcactccttgcaatcaatagacaatgtttctcggaaaaccaaacaaaactctccacctcctcctctactaccaccaccaccattattacacccatcaatatcacctccgccaccgaggctgcaccaccacctcatgctggacagcctttccatgacttcgccgacgacacatgtcgacacggcagcattgttacagctgattatgggaccacatccagcaatgccaatgctggtgggtctacgcttataaggtttgggaccactactgctggcgatgtgtctctcactctagggttacgccatgctgggaacatgcctgagaagagtcctactttctccatgagagattttgggggctgttgattaattacataatcataaacttttatatagtacctttc

SEQ ID NO: 17463 - DNA, 650 bp, Populus trichocarpa
  Predicted polypeptide sequence is orthologous to G419
ttttttttttttttttttgaccttataagattaaatctagctgtattgacaaatgatttacttttatctaccaacagattaaaacttcctctaatcttttcaacgatactccataaccaacaactcgcttttgtcacctgagcataaaaaaatggctaataaaaatcattatacaagacatgtaacaatatcccgcccaaaagcaagattaacaagtcaacgaaatgatgctcttttttaaaaaacaaaagaagagcacgcatcaccaccatcatcatgtgaccaacgacaagcatacaaggacagatcttaccgaactgaaggatctgaagcaggacaagcaagggaaagggaggaaacagctggagatcaccggtatgggaggcgttggaaagaacagactttggttaattaaaaccaagcagtactgtccaatcctcccatacccgtaactcccagcaaccctctttcctttccctcttgctccttgattaattttagatcacgcttttgtctagaataaggaaagagaggagtcgcagaaagcagatggaatgggaggagtaggcaagaaggaatattaaatcatgaatttttcttcttgcatactctcccatctccaaagacttgctaggactctccgtttctcc

SEQ ID NO: 17464 - DNA, 844 bp, Populus trichocarpa
  Predicted polypeptide sequence is orthologous to G427
ttttttttttttttttttgtaatcctgtttgaactcgtgcttcaattcttgccttacacgctccatcaaggacctctcagtttcagtggggactagaggaccaaatcccatggtatccaacccatcaaggtttccatcattaaagttggtatcactttctgcctggtcatcttcgtcatcagacatagttgcaccagtgccttccccaggagatacgccagtcaaactttgtagagattgttcaagttcccagcaagccattactgcctccatagcatgaacacggacatgttgctgcaattggtctttgaaggaacagagaagtagagcgtaatgtgtcatgaactgatcaagttctttctcgtcaacaacatggccacaaccaacaccagaatacttagcaataacatcttgagaccgagccaactgtgtatcaatcctagccaactggtcaactggcgttgcaatccttaaacaagccacgtgtgcagccaataattgttcataaaaaggatgccctaatatctcagctttgcatttagctctctcccagttatcactaacagaatctaccaactcctcttcacttccattgttggtggtgttttcggttttttcgatggttataaagtcgccgttcctacggaggaccgcgttgcttagccatgggggaccggtggaagacgaggctgagaggtggtggtgttgtagctgaaaagccatttcttgtggtatatggtggtggtcttcaaaagccattagaagtgggttttcatttcaacacgaagacaagagagacagggagagggagatgtgggaaagaaagaaaagtgggtgtgtgtgc

SEQ ID NO: 17465 - DNA, 919 bp, Populus trichocarpa
  Predicted polypeptide sequence is orthologous to G427
ttttttttttttttttttagagcatgggaaaagttgtgattgaatggtttggaatgtgtacactgaaaaggatataattacattaccttatcacaaatattgaacataaaccaataattgcaaaattacaggcccatggcacagaaggaagctatccaaactgacacttccaatctcatatgtttataaactaggacatctattgtagcagtatgccatcatagcacacttctcaactggaaaatgagtttagcccatctctacatattgaatagcacccactttcaaagaaaagatgagctttccagtatgagcatatccaaacagaatatatctacccttaattcttgttgattccaatggccccaaatgtgttctgatgctcttcccaggtatgtacacgaaggcaacaatagcaagcagtctaccttcaagtctttccatttatatgaaatgctttatgttcttgaagaagccaatgttcacagagaaacatataatagtcagcttacttctttcgtttgctcttcgaggtagatcctgaagggctgctgtgccagttccttttcctttggtttatgaaccaattatttatctgctttaactgcaacccagtttcctgcaccaatcttgctttgtcctcctcagatgggtacggccacttggaatgtgtttgccaccaagcttttaagtgggacgtggtatcacctggcagtttccctgctcttctcttacgtaaaatttcctctctaatgtccacaattttctctttgtaatcctgtttgaactcgtgcttcaattcttgccttacacgctccatcaaggacctctcagtttcagtggggactagaggaccaaatcccatggtatccaaccccatcaggtttccatcattaaagttggtatcactttctgcctg

SEQ ID NO: 17466 - DNA, 681 bp, Populus trichocarpa
  Predicted polypeptide sequence is orthologous to G427
ttttttttttttttttttgcccaattaaggatcgttaattaaccaatcaagcataaacatgaatatctcatacaaaaaatccaaacttgagctcgctcaaattcaacaaaaaacaagcagacaggagagaaaaagattaaagaacacaaaaaaacgacatataatgaagaaaacattaaaaagatactagtaattaccatgaactgatcaagttctttctcgtcaacaacatggccacaaccaacaccagaatacttagcaataacatcttgagaccgagccaactgtgtatcaatcctagccaactggtcaactggcgttgcaatccttaaacaagccacgtgtgcagccaataattgttcataaaaaggatgccctaatatctcagctttgcatttagctctctcccagttatcactaacagaatctaccaactcctcttcacttccattgttggtggtgttttcggttttttcgatggttataaagtcgccgttcctacggaggaccgcgttgcttagccatgggggaccggtggaagacgaggctgagaggtggtggtgttgtagctgaaaagccatttcttgtggtatatggtggtggtcttcaaaagccattagaagtgggttttcatttcaacacgaagacaagagagacagggagagggagatgtgggaaagc

SEQ ID NO: 17467 - DNA, 946 bp, Populus trichocarpa
  Predicted polypeptide sequence is orthologous to G428, G1594
ttttttttttttttttttgggagtagattattcattcaaactatgtaagcattaattgcgaatatacatgatgcaaaatacaattaatcttcctttcttttttatttctaaagatgaacttttcaatgccagcaatgttgcgttgcataatgtacatgaagccaacaggaatatcagtcgtcttctgtaaagaactgcccagaaagattatccataacagcaaattgcaggttctcagatggtttccagtggcgcttacgttgatttataaaccaattattaatttgcttctgatctagtcccgtcgattccgccaatgctatcttatcagcttcctggaaagatgattaagcaagcaaattatcgtcttaccagcgttgaactttggaaaacaattaaaatcctgcctgcacaaattcatagcatttacatatatatatatagctaccagcatcaaatgaaacatctacatccggcccatctgtaactcgtttataagaatcaaaagacataatgctacccttctcagtttcacacctgaaaataatttcgtgcgttctatgatatcctatgcatcggaaatcaggacttgcatatttttaaaaaaactaaaatagatgcagcctcaaggagagagagagatacacacagttggatatggccatttatagtgagcatcccaccatccaagtagggtttgcctagcttccttcggtagctttcctttcttttttttctttgagaactccagcttcagcgtaccaatatgacttccaaacctgcggagaagtttatctttaagctctcggtcttcaccacttggttgagcttcatgcatatccaactcccctccacttaactcctcatctgatgatggcgcaccttcatcagagatgcttctgatggaggcaccagtgcagagattacgaagctgcatttcaatctt

SEQ ID NO: 17468 - DNA, 714 bp, Populus trichocarpa
  Predicted polypeptide sequence is orthologous to G431
ttttttttttttttttggtttcacaacattcaactacattagatagcctccggatgcataaaagtacacaacatatataatttgcatgtcaaatggggcaagcgtattaagaacttcacttgcattccagcagtgaagatcaatcatgtatcatgcatgatcttcaaagcagtgtgggagagatgtccattgggaaaggattgcccaaaacattatccatgtagtaatgaggatggccggcatccatcaccacaaactgcatgtcttccgatggtttccagtgtcgtttcctttggttaatgaaccagttgtttatttgcttctgatccagaccagtggattcagcaagggccagcttctgtgactccgatggatatggccatttgtaatgcctgctccaccaatccagcagctgttgcctggcttctttaggtaacttccctttctttctctttttcatgaactcctgcttgagactgcctaaatatccactgtacctgcgaagtagctgacccttcagctcttgatcttcagcttgaggatctatgaagttgttattcacatcaacctcttcttcagatgacacattcctatcattgccatcaccacaaccagaaattggagaggaaagagtgagagctttgaattgacactcaaccctctgaagaaaaagcatggcttcctttaagggtttagagagctcttgctcatact

SEQ ID NO: 17469 - DNA, 901 bp, Populus trichocarpa
  Predicted polypeptide sequence is orthologous to G435
ttttttttttttttttttattcaagaagaaactttgatagattaatactagtgaggctatcatagatcagtcaagagatcaatctgtttttctagcagctacagttcgtattgatctgttgaacaaagtatagacaagaaccttctaccaattagagaccaccattccccacaatagcaggagcagctatatattgggctaattttggcccatcaattttgacgcaaagatcaaaatgccaatccgtacttgctgcaccctataaaagggcactcgaagattatcctttctatccacgtcttgagttctaaatttctaatcttcagaaacaccgaaagacatgaattcccatttacaccaccagtcacaaagccaaggcaaccgacctctcaaacccagaaagaaaaggcttgctagagaccagcttaacctcctggaaacaagtttcaatgctaaccagaagctcaaagcagagcacaagactgagcttgcccgccaactaggcgtgccaccaaaacaagttgcaatatggtatcaaaatagaagagccaggcacaaaaatgatgccatagagcatgactacatgaacatccagctagagctaggtaatgtattggcagaaaacatcaggctcgagaaacaagtcagcatgcttaaatttgagctgaacaaggttcaacaaatgatactttttggaccaacctcatctgctgcaactctcccttcagtgtcaggatctagtgatgagcaggcaaactcaagttctcctggaaacatgatctgtaattggggagacgctggaaatgatgacatatttcctgtagaagagctatatacttgtttgataggctctgacactcagttatgggctcttaactgaaccagcgaatcctcaatcatg

SEQ ID NO: 17470 - DNA, 897 bp, Populus trichocarpa
  Predicted polypeptide sequence is orthologous to G435
ttttttttttttttttttgcgaaaaagggatcagcttctcattaactgtacgaacaaattaattacagagtgcataaatacaagttcttcatctctgtcacttcaaaactggtactttgagattatcttgacctcactgatatacagttatctaactagctaagcatacagtatctgagtttgaactttacttgatagatattctgatacgaacttacaggactaacaatacacaaaaacatggcaagaaattaactaatctttacatccttgataattactcttattataattcatctctgctttaatttcaatctgtgtaatgttcccagttccttaccttgccttactttcgaagaaaattaagagaacaattgatggtttggaagtaacatcaagggccactaatcataattaataacaagtcagtctctccaacactcaagacaccatcaatcataggcagtatatatatatatatatatatatatatatatatatatatatatattagatatccacaacaaagtagactccaatatttgtgaaattaacgtctcatacttaatttgttggtgagctatcacatgaactaggtccacttaagagtttctccactcatggtgccgatcagcacttgattctgatgagtcgttatattatgacagatgacatttgttgccgcacctaattaattaaccccaagttgacccaccagcgccatacaaacaagcatagagctcttcaagttacaagacctcaccattcgcttcctcgtgcaagctagagctgcctccctcatcacaagaggagttagaagaaacattaacaggaggttgagctggtccttggttcaagtggaacaccatttgttgagccctcctcaactcctcttga

SEQ ID NO: 17471 - DNA, 905 bp, Populus trichocarpa
  Predicted polypeptide sequence is orthologous to G440, G864, G1421, G1750
ttttttttttttttttttagacaattatcgccatataattcactaaatatggactaattaatactccactatatacttaaactccgtagtttgactaatcaaaccaaaaacttgacataaaaaataaagggacactttaggtattccagctctatatcaggcgccctttctatccacttggcgcctttaatcacgaatcatggtatgccacatcccgatagggttgtgtcaaattacaaaagactccccaaacttccacaaaattgaggatatgtttttaacagatggcatccaccaagaaatcatcgaggtcaacgaattcttccttgtcaaagaaattccccgacaacatagaatttggcaaacttaacggcacgtcaatttcgaacccaaaagcgtcaacgtcaccgtaacccaaactatcaaacggcgataactcttcgtatgggagaacagacgtcggtgatgacatatcgtgaacaccacttaacggcgactcacatgactcgcgctgaccatcaacaaccttagccttctccgttaaaacagcgtcagacggtgtcaaatctacgtaacggaggactaatgcgggtgatgccataacgttagcagtacccctgatagacggcgactcccgtgattcacacttcacatcacttgaaccggagttaacgtgagctttctccgttataacggagttcgtaggaaagttggtaacggcgtcgggtccttttagtttcagtgcagctcgatcatatactgtagcagcttcctctgcagtgtcaaaagtgccgagccagacccgtttccgtcgagtcgggtcacggatctcggcggaccacttccccagggtctctgacggacacccctgaactttttctgacgagatacatcaggtaacggta

SEQ ID NO: 17472 - DNA, 912 bp, Populus trichocarpa
  Predicted polypeptide sequence is orthologous to G440, G864, G1421, G1750
gattctctctcaccctctcccctctccctcacacgcagagagagtgaagaacactgaactcgcagcaagacgttattctttttctcgtttcccactaaaagcttcacacccttttcgccgtttcaggctagccaacttcttcgtgaaatccaggagttgctgctccacaaagctagctctagctttaccttccctctttcgttactgtatttataagtacaccttccaactctcaagatccaattaatcttagtacatattaagtggcttccttcactcttcttcagtttttttcttcatctttcacttcattcatcagccagacaaagctggctagctagaccaacttgagctggtcaatacatggttttgcctctacgtcttcacccacttcttgatcacaaaacccagccctttctaccactctttcatcttctatcccccactaaatcataacccatgctgatctacaaccccaacaccatgtccgtacaatcaaaagtcaaatttactgaacacgtattcgccactaaaaagctcatcaagaaccagcagcagcagcatccttcttcaaggatccgcggccaaagacttgttagaatcatccataccgaccctgatgccactgattcctccagcgacgaaggagaagaacaagaacaggagaggaggtttgtcaggagagtgaagagacaagtgagtgaaataagattgctagagcaggagacaacagcaccagcagctccttcttcaagaacttcaaatgatgatcatcgagacccaacaagaaagagacctttcttcagactaccggtatccgacgtcactcgccggaaaaacttcaggggtgtccgtcagagaccctggggaaagtgggctgccgagatccgtgacccgacccgacggaaacgg

SEQ ID NO: 17473 - DNA, 798 bp, Populus trichocarpa
  Predicted polypeptide sequence is orthologous to G440, G864, G1421, G1750
gcactcacacacacacacccccccagagtgagtgaagatcactgaactgcagcaagacacaagtctttttctagtttcccgccaaaagcttaccacccttaatttgcagcttcaggctatctaacttcttgatcaaacccggagttgctggtgtcactttgtcaccttcttccaactcctcgaagtgcaagctatagcttctctttttgtctctatagttgtcactagctacttatataatccctccaacgctggagatccagttaagcttagtataaagtagcttccttcagtttttttcctccaagaaaccaataagaatcttcatccttgatcacccaaataaattaagctagctagaccctacctgagctggtcagtacatggttttgccgctatgtcttgacccacttcttaattgaatacaaaaaccaacccttggtaccacccaccatgcatcttctattccccaatgaattacaacccatgtttacctccaacgccaccatgtccgttcaaccaaaagtcaaatttactgaacatgtattcatcactagtaagctcatcgagaaccagcagctgcatccttcttcaagaacccgccaaagacttgttagaatcatccataccgaccctgatgccactgattcctccagcgatgaagaagaggaagaacaagagaggaagtatgtcaagagagtgaagagacaagtgagtgaaataagcttgttagagcaagaaacaacagcaccagcagctccttcttccacaacttcaaatgatgatcaggaaaccaga

SEQ ID NO: 17474 - DNA, 658 bp, Populus trichocarpa
  Predicted polypeptide sequence is orthologous to G447
ttttttttttttttttttcggctttagcttcagcttatttatgggcagaactaacaaatattcaaagctttgtccctcataatttcttgtttagagtttcaagtctaaacagataaataagattctcccgcccaaataatcagtctttccaagcagatctcaaaattctagtaaatattaatacaaaccctaacacaactcaataaaaattcaatcacgctacaaaactctcacaaagtacaaatatataatgactgcatttaaagcgtgtcctgctcattcagattacaagctgttcgtcgttgtcgttgtcctcctcctcatcatacccaacacccaagttaagacaccccggaagctgcagctgcaacgtacatgcctgggtcctgatttggtggcatagcatatccattgttgctgctgctgcatgtgtgggacccactgttgttgatgaggatgttgaggttggtgttgtggagatgggttctgatcaggaccgttgccttgctgcatcttgatctgaatatgattagtcaatctcccccctctcctcctcctccttcttccagtactaccactactctcaaagcaagtaaccttgtttttgtttacttttggagagagagtctgcgtgtgaaaggagaggagaggagagacc

SEQ ID NO: 17475 - DNA, 332 bp, Populus trichocarpa
  Predicted polypeptide sequence is orthologous to G450, G456
ttttttttttttttttttacaaatgtctagatctttgatttctatatacgtacgatcaaatgaaaatacagacacatttcttaagaaataacagcagcaacaacaataataataataataaaaaatatagtaaagacatgcacgaaacaccactactgatccttcaatggatgttgagcaagtgccttgtctgctagtcttcatatatggatgcaaggctaaaaggagggaatccagcagggccggaacctgaatacattgagtacataagattcaggttctgctcttgcatttctccattgctcttggtgcaagtccaatggcttcagatc

SEQ ID NO: 17476 - DNA, 929 bp, Populus trichocarpa
  Predicted polypeptide sequence is orthologous to G450, G456
ttttttttttttttttgggtaaattattacgcaagccattagtaataaacaagccagacaacagggggttaagttcttgcttcttgtccattacaaatgtctagatctttgatatctatatacgatcaaacgaaaatacagacacatctcctcaaaaataataataataaaaaaaagtacagacagatccaggaaacaccactactgctccacccacgttgcacaagtgccttgtctcctggtcttcatggatacaaggctgaaaagagggagttcagtagggaagctaaataaattgagtatacaaggttcaggttctgctcttgcatttctccatggctcttggtgcaagtccaatggcttcagatcctttcatgatgcgcaggcgcttgcatgaattgacaaacatctcccatggaacatcacccacgagcatccaatcaccatccttgtcttcgtaggatggcacatactcggaactattaagtagatccatcaacttgctctcattcataaagtctatcattccctgggctccataattacccatggtgaaggaactgaacattttggccaaggcatcagataattcttggtagctcctgtacatcttcaagtccaccttgcgaagatagggtgcaccatccatgcagaccttcacaaatgctgcactgctgccgccagtgcttgccttctcgccttcctcactggcgttcttctgagccataacgttcttcctgtaagatcgaactggtggccaacctacaacttgtgccttggccggtggcttagcagggtccttgatggtacagcagggagggtgggtcttgtcctttgaagtaatattcttgatattctcattcagatccatgacaccctctttagcctgaagattaagcttcaagtcaacagtctcagcaaaccctctt

SEQ ID NO: 17477 - DNA, 895 bp, Populus trichocarpa
  Predicted polypeptide sequence is orthologous to G450, G456
ttttttttttttttttttacaactaacaataggtgattattacacaagccagccaatcgggggttaagttttttgcttcttgtccattacaaatgtctagatctttgatatctatatacgatcaaatgaaaatacagacacatttcttaagaaataacagcagcaatattaataataataataaaaaaaaaaaaagagtaaagacatgcacatccaaagaaacaccactactgatccatccatgttgcgcaagtgccttgtctgctagtcttcatatatggatgcaaggctaaaaagggggaatccagcagggaacctgaatacattgagtacataagattcaggttctgctcttgcatttctccattgctcttggtgcaagtccaatggcttcagatcctttcattatgcgcaggcgcttgcatgaatcaacaaacatctcccatggaacatcacccacaagcatccaatcaccatccttgtcttcataggatggcacatactcggaactgttaagtagatccatcagcttgctttcattcataaagtctatcattccttgggctccataattacccatggtgaaggaactgaacattttggccaaggcatcagataattcttggtagctcttgtacatcttcaagtccaccttgcgaagatagggtgcaccatccatgcaaaccttcacaaatgctgcactgcttccgccagtgcttgccttatcaccttcctcactggcgttcttctgagtcaaaacgttcttcctgtaagatctaagtggtggccaacctacaacttgtgccctgaaaccttcctcactggcgttcttctgagccaaaacgttcttcctgtaagatctaactggtggccaacctacaacttgtgccttggc

SEQ ID NO: 17478 - DNA, 819 bp, Populus trichocarpa
  Predicted polypeptide sequence is orthologous to G450, G456
ttttttttttttttttttatttaagagctatatattatcgttcttgtccatgataaatattaaggatcaagtagcatctcgcaaaattaacattatttaacaaaccacgtacaattaatattaatgcagaaacaccctcaacgaagagcctgctcaatccatccagcgcgcttttaccatcttaatttttggtccctgcatgcgaccctcgggatcgaaggagcaggctgtacgtggtgctcactacttgaagcttctgttcttgcatttctccatggctcttggtgcaagtccagtcgcctccgttcctttcattattcgcagccgcttgcatgattcaacaaacatgtcccatgggacatctccgacgagcatccagtcaccgtccttatcttcataagttggaacatagtcggtgccattaagaagatctatgagcttgctttcattcaggaaatctttcattccatgggatccacagttgcctatggtgaaggaactgaacattttgcccaaggcatcagagagctcgtggtaggtcttgtacatcttcaggtccactttacggaggtaaggtgcgccatccatgctaaccttcacaaaggttgcattgcccccaggaaccttgtcagtactctcctgatcggtgctgcttttttggacagctaacatgttctttcggaaagatctgactggaggccaacccacaacctgtgccttagctggaggttttgctggatcagtggccagaaggttcttctccctttgagtcttcccatgatttggatcaatacccccctccttggaagaaagattgac

SEQ ID NO: 17479 - DNA, 824 bp, Populus trichocarpa
  Predicted polypeptide sequence is orthologous to G450, G456
ttttttttttttttttttcttttttttttttttttttttttttttttttttaagcaagccattctgataataaacattacacatgatcaaacataacaaaagaagttttataaacatcttcttctattattacttcatgctcctagctagctagttaacaaatcccttcaaatatatttcctcatatacttgaaacttactatgtatgtgaaaaagaaaaaactaaaaaaaaaaaaaaacaaaacaaaacatggtacataaacatccaaacttcaaagctcaaatccctttttagcctgtcgttccttttctctggggacgattggatcagctgaccaaattgactgggaaaaaagcacttcaaattctgttcttgcacttctctacggctctcggggcaagtccaatagcctcaaaccctttcataatcctcaagcgcttgcatgaatccacaaacatttcccatggaacatctcctacaagcatccaatctccatccttgtcttcataagttggcacataatcggaaccattcaagaaatctatcaatttgctttcattcatgaaatctttcattccttgggagccacagttaccaatggtgaaggagctgaacattttgcctaaagcgtcaaaaagttcttggtagctcttgtataatttcaagtccacttttcgtaaatacggagcaccatccatgctaaccttaacaaaagccacaccggtgccactgctaccggatttttcaccgttgtcattgctgttcttctgtacagccatgacattcttacggaatgatctaatgggtggccaacccacaactt

SEQ ID NO: 17480 - DNA, 502 bp, Populus trichocarpa
  Predicted polypeptide sequence is orthologous to G451
ttttttttttttttttttggagaatacttgtgatctgatgtagaactctttgtacaattgcattcaagaagcaaatttgccaactatacatgcagatctgtgatatcctaacaaatccttgtaaaatcttctattacatgcaatcccacaaaggaaaaatccagatccttttttttttctttctgggtgataaaattgatccatatttgatatttcttctcggagaacccaggctaaaagtgcaactcttccctttctctttctgatctcttcttcatcttttgttaggggcctcctgaattgcatgtgtgaagctttacacagcacaacccaaacctctagcttctgactctttcatgattctcagcctcttacatgaattgatgaacatatcccatggaacatctccaaccaacatccaatctccatctttgtcttcatatgttggtacatgttctgatccattatacccttccctctccgaatactcaccaactttggc

SEQ ID NO: 17481 - DNA, 809 bp, Populus trichocarpa
  Predicted polypeptide sequence is orthologous to G451
agccagagaaaccatcaactactcctagtgttaggagtaataagagagcctcgccagaaatatcagaggagtccaggtccaagggcagttctagtgtgtcctccaatgtcgaaaatggtgaaagagacagtgcccctcctgccaaggcacaagtagtgggatggccaccaatccgatcttataggaaaaattgcttgcaaccaaagaaaaatgatcaagttgatggtgctggcatgtacgtaaaagtgagcgtggatggagctccttatctcaggaagattgatcttaaggtgtacaagagctacccagagctcctcaaagccttggagaatatgttcaagcttaccattggtgaatactcagagaatgaagggtacaacggatctgaatttgctcctacttacgaagataaagatggagactggatgctagttggcgacgttccatgggacatgtttatctcctcctgcaagaggctgagaattatgaaaggatcagaagctagaggattgggctgttgataaaacaaaaaacaaaacttgaaacctgtcaacaaaaggagatatggtgatttaggggaagagtaatttggctttggatatattctccgagagattaggtctcttaggaacagaaacaagttgatcagatcttctttttttggcttcggttctccctccttggttttggtttccaagatctggatatgtatcaattaaactatagagacagaaagatcacacttttttatctgaattatatataaacgagcgagtctccaatattcagtgcgaaaaaaaaaaaaaaaa

SEQ ID NO: 17482 - DNA, 772 bp, Populus trichocarpa
  misc_feature (80)..(80): n is a, c, g, or t
  Predicted polypeptide sequence is orthologous to G451
ttttttttttttttttttaaagcccttaaaaacagacttttgtatttagctttagcggtgtccttaaaagattacatggnaaaaacatggacgaccctgtcttaatttccatatgtttcttttctgttttgattttacataattgcatttgaagcaataataacttcctgtatccagttttggtttggtgagattacaaggaccaacaaaatgacaccatagatgtccaaaccaccagatatctcgctgccacaccctacgatatatagaaaccgtaacttcactctgatttttcctgtttcctgtctaaaacttccagccatctgtagaaaacccagtcaagagagagacccatatttttatttgagttttcttcctggagaacccaagctgaaagattttctcaagggatgaatcttctcttctccctgatcctgtgggttaacatggcctgtgggtttttcatacaccacaacccaaattaacctgttgcttctgatcctttaatgattctcaatttcttacaggatgacaggaacatactgcaaataagaataaaccttgtgagaaaatttatcacataacatacagaaatggattcaaatgatcttgagagagagaggcatgcagaacttactcccatggaacatctccaatcagcatccagtcaccatctttgtcctcataagtaggtgcatattctgatcctttgtagccttccctttcagagtactcacctggcatagttacagatttcatcatcagaataata

SEQ ID NO: 17483 - DNA, 868 bp, Populus trichocarpa
  Predicted polypeptide sequence is orthologous to G461, G462
gaaccaaagttccaaagacgaatattgcaacccttgcccatcaccaagaaaaacaaaatggcacaacctcttggactagaaatcacagagctaaggttgggtccaccgggcagcgaaaatggaccaaaaaatgaaaagaaaagggttttctcagagttgtccggcgaagcaaacagcacaaccgatgggcgaaaaacccaaacaacgagtcaagttgtggggtggccaccagtatgttcctatcgaaagaagaatagtttcaatgagaaagatagccatgaaacttcaaaaatttacgtgaaagttagtatggacggagctccttttctcagaaaagttgatttgggcatgcacaaggagtattcggatcttgttgtcgcgttggagaagttgtttggctgttttggaatcggcaaagccttgaaggatacagacgactgcgaatacgttcccatatatgaagacaaggatggagactggatgctagtgggagacgtgccttgggagatgtttattgagtcttgcaagaggctaaggataatgaagaggtcagaagccaagggttttggactgcagccaagaggtgctcttcagcagggaaatatttcaaaagatgatcgtgactgagaaaccacacaaaatattgaattcggaagaatttgactggactgccttcttcgtaaagaaaattatttctgtttaattagtgatggtcgattaagatcaaatcacggttcatcatccagttataactgtgaggcctatttttatatatgtttaaatccggagataaagaactctagataggaaagacaatctgcttgtttatgatcataaattcatgctgttatatttgctgctaaaaaaa

SEQ ID NO: 17484 - DNA, 866 bp, Populus trichocarpa
  Predicted polypeptide sequence is orthologous to G464
ttttttttttttttttttgttcttcacctccttaacgatgagaaaaagattaagcattcaggaatttacaggtcagtaagtgccattcagtgactatgcatgtatatattacagcaaaaggtaaggtgcttgttgcttccaaaacagtaaggcgggtattttcagaggtataacaagaatgaacaaatagtataataagaccatacagcaaccaaatccaacacaaggccgctgaggaccattaattactttttttatcaaaatgttttgactataaacactctttgttttttcctttgtatatcactcttcaatccaaagtttttcttcattacttatatttagggatagatgtccagataggcttggttctttgtcttccactcctttcttgcgagcttggagattcatttgccaagtccagttgcctcggacatcctcatgattctgagtctcttcacagagctaataaacatcccccaaggaacatctccgacaagcatccaatccccatccttgtcctcataagtgagcacaaactcagatgacccgcccagcaattgtgagtgtctttttgcatctatcattattttatgttcaggtgtgctcaatcgtgccatgttcaaagttgtggtagttcttaggaacatattttccaaggcttgagccagtgtctcatagcagccatgagcattcagatcaacctttctaccaatcagggttccatccatattcaccttgacaaatagggaagtcctagtcttggtattaccaatattaatgtttttgttgcccaccttctcttccacagcattcttgcgtttattcattgagttgaactcttcagtagcctgtgactttgcctg

SEQ ID NO: 17485 - DNA, 496 bp, Populus trichocarpa
  Predicted polypeptide sequence is orthologous to G464
ggtacttctagtgctggtgcccggtatttttctccttgtctcctatactgtaacgcattctggtttcttctctttaaaaaaagcacacttctttaaccttttcttgaatcttgaaaattcaaagactgtatcttgatgatggaaggctgtcttggtttacttggtggcggtggttcttctggggcctccacgaataagtccacactgtcaaaagtggaggtgatcgaggctgaggcaagttcatatccagtggaagctgagctagagttgggtctggggctgagtcttggtagtggtggaagaggaaagggtaaggcaaatgcatggggtgagtgtggtagaatcttgactgccaaggactttccttcggtagtctctcagcctcaaaggcccaacaacaacaactctatgccttctacctgtgttgttggtgctgtttctgggactaagagagctgctgactctgtctcccatgagggtggatcccctactgctg

SEQ ID NO: 17486 - DNA, 904 bp, Populus trichocarpa
  Predicted polypeptide sequence is orthologous to G470
ttttttttttttttttttggtgtataaacttacttacattaagaggtagggtaaaggtaaggtagttatgtacaaggttcaggatggtttggttcagaaaaaaagcaagggtatcgctagacattgcggctatatataaattatgtataactggacaccatacaatactagctccataaaaggtccaaaattggattatatcattcttgcatctattttttatagcagcaaacttgacatcttgaatagtagtagactggcacccatctcattcttaccaactgaaatagccattgcactctctagctgcctgaacccaaaaccttgaacccgaggaagccaaatctaacaactcaaaggactagatgctgaaggaagtggcagatgtttggcttctttagcatcctcaccctccacgcccgatggattttcattgactcttgaatttaaagtgcctggtttaatcctctgtacctcctctctggtgtaaataacaatcttcctaaccatgccgacgaattcctgccagggatcatctccaacaagcatcatatcatcctcgtcatcagtatacacaatcaaccaattcttttggggagccagtaattcaccattaaattcaaacaaccggtccaattcagcaatcaactcatcatagttattgaacctcgtaagatcaacggatctaccaagtgcaatcccctgcttgtgaacctttgtacaactcctggttgagctgttttgtgcttttccatgactgtccctcatacgcatgtggccaacctggagtggtttctcgttttcattttcatcggccaactttgaacccctggagtgttctgacttctgatctgattcagatgtgagttggtgactcgcaggttgggtgtgacccatcggttcg

SEQ ID NO: 17487 - DNA, 434 bp, Populus trichocarpa
  Predicted polypeptide sequence is orthologous to G470
ttttaggcctgggcaatgcatgaggatttagtgcaggaggtgctagagcaggctcaattttccatggtgaaactctctctggccgaggcatggtagaagtttcatcccatctcaccttaaggcacctccatttagaattcttccacctcccgggatcggcatcttcaattccaacaatagtgccagtaaatctttgctcaggagcttcttctccttcaaatctcattttaaacctcatccctatggaataattattcttgacagactccatgtattgatcaaaggggacaatgaactctgcaggacttgtccttggcttgtaataaacagtgaacagggtccccgttgaaacagcatgccatgctgtagcaagcaccccaagatgcatgctgtggctggatatgacagatgatggaacattaccctgctgtctc

SEQ ID NO: 17488 - DNA, 852 bp, Populus trichocarpa
  Predicted polypeptide sequence is orthologous to G475
ttttttttttttttttttcgcccaaataatatatatggcatccatttattgaatggtattaattaagtacagatcatagattataattaatatgaaagctaaggattgacagaagagagagagcatggcaatgatcacatatttagatattttaaccaatctaaatatgcttggaagaggcactttatgggggaaataatacgtaattgtctccctcttatgtagtgagccttcctccagcactcctgagagatcacaactcttgtcagttcgatccttctccttgatattcggccgagcttttcctacgccgttcattgtgccctgctaaacgcctccggcagctccttttgctgtcatcaaactctgataaatcatggaacctgctacattgctggcaaaagcgttgctgcagtccattgacgggagcaaagggagctttggcatggaactcacaaaccttatggcgtctatggtatcgcttggcatcagtcagatcagaggtgcaattatctgcttgacaagaaaccagcagcattgacgacgacccaccaccactagatcctttctttcctttcttcttgatcttgtcatcatctacaaaccctagccctccagcaatatcatcatcatcctcttcttcctcttcatcttctatttccttcaagctcctctttccttcagctctgcttgtttccatattcagaaacaaatagaagggtagctaaaaagaagaaaacaaaagatatgaagcaaacaagaagctacaagaccttgataaataaggtggaaaaaggagaagaactttgtgtgaggaccacattcttcatttttttttttattccttatcac

SEQ ID NO: 17489 - DNA, 899 bp, Populus trichocarpa
  Predicted polypeptide sequence is orthologous to G477
ttttttttttttttttttgtgctatgatatactcagtcgtacataatttagtaattgaattcttgtccagcacagtatttccaaatgaaagttgaaataagtcatctctagcaaaatcaaacttgcatcaccttacaataataataacaacaataatattaaaaaaattccacatattgttcgtgttatttacctttcaagtaaaggaatgcacggcaaacgcaagctgaagtctcttaagggcctattgtctactgcaccgataaagttagtagttatatctgatgcaggcaagcagcttgccatcaattctctcctttgaaccttgttcctctcacaccccataagtagagccgaaactgcagaactcctcattttcatgcttcacttgcatggagttcctctgttgctccaccctctgaagatgtgatgagagttgaagcaaatccacagttgatccattttcaggagaaacgcaatacttcgcattcaaaatatctgactgttgtagaaatccatctgtttcaacttggaagtccgctgcgtgaccggaaccaggaaccacaaatggccccatatcgttgacttcaatgaaattcattccagacggatagagcccatttgggaagtacttttccaaggagcctacccctaaagatttgttaacattacccaagctctgacaagcatgactcacttgactgaccaagggcctagccgttatatttcctgcagaatggctcaagtcctgtgattcagctgacagaagagagagagcacagctagagtgcgacgccccagctaactcatgaaaagttgttgtgttacaaaaattgcggtcatcaattgccggtgaagaaattcacaagtcttttgtaacccattgccgtgcaaatgga

SEQ ID NO: 17490 - DNA, 945 bp, Populus trichocarpa
  Predicted polypeptide sequence is orthologous to G478
ttttttttttttttttttctacatatatagttattttatcgtttgaggagagaaaaaacattagcagagagcagatactacatttgattttactaacacaatctaagagtgagcattaaatgaacaataatcaataaagagagggcaagttaagaaggaaaagtaagtatataacacttgagagtaacactatatatgttactgcttagttaatccactaaatccttcttcatttcattgaccctttttatcctctcgagataaaaggtgagcttgatgatgtaaaagagggagccgtagcttgatatgctctttgcttgaaacaatccaaagacattcgaggtggcgatatcgctacggtagtcgccgatgaagtagagtgagcaccagagtcaagtggagaccttgtgagaatgtcagatgagggattagcagcattttctagctgtgatctctgattttcttgattaacttggtgtgattttcgcctgcgacgattgtgatcagccaatctctttctgcaactacgctttccattatcaaattccgagagaatatgaaacctgctacactgctggcagaatcgctgggtcaacccggctgcgatgacagtagaagctttagagtgaaactcacagactttatggcgtctatggtagtgtttagcatgggtaagatcagcattgcatccttcagcttgacatcttaaagcatttgacgaagaaccgggatcaagtggtctagaccggcggtatagccgcttcacaaaatcatcctcagccgaagaaaaataagttcttccccctaaattcagtcctatccttgaagtgatcaaatcagaaggccgagaaatttcctcgccttttggtataaggaaataaggggttgcagttgcaactgatgtgattgttgggattgagtcaagggaaaggagggaggtatcgt

SEQ ID NO: 17491 - DNA, 840 bp, Populus trichocarpa
  Predicted polypeptide sequence is orthologous to G478
ttttttttttttttttttcgctccgtgagagaaatatattagcagagcagatactccatttggtttttactaacacaatcaagagtgagcattaatcaacaataattaaagagagagtaaattaagagggaaaaataaatataacactggagtaacactatgttactgcttagttaatattaaatcctccttgatgatcaggtcattgacattttttacccgcttgagaaaaacagtgagcttgacgatgtagaagaagaagcagtggcttgatacgatctttgcttgaaacaatccagagacattcgaggaggggacatcgccaccgtcaccgatgaagtaggatgagctccagagtccggtggagaccttgtgagaatctcagatgaggaaatggtggcattttctagatgtgatttctgattttcttgattaatttggtgtgattttcgcctacgacgattgtgatcagctaatctctttctgcaactacgctttccattatcaaattctgagagaagatgaaacctgctacactgctggcagaatcgctgagtcaacccggcggcgatgacagtagaagctttagagtgaaactcacagactttatggcgtctatggtagtgtttagcatgagtaaggtcagcattgcacccttcagcttgacatcttggagcattagatgaagaaccgggatcgagcggtctagaccggcggtaaagccggttcacaaaatcatcctcagccgaagaaaaataagttcttcctcccaaattcagtcctatccttgaagtgatcaaatcggaatttgaacgaggaatttcctcactttttgggata

SEQ ID NO: 17492 - DNA, 863 bp, Populus trichocarpa
  Predicted polypeptide sequence is orthologous to G483
gcgattggggtaccgggcccccccggtttttgagctttcagagaagattcagctaaaaagatttggtggtattctgatgagagatagctagaaagagggccaaagaaactctacaagcatccatggaccaatcacaacaaacccgacagcaacagtcacagcagcaacctgtagtagctggtgcaggtcagatggcctatgcttctaccccctaccaaactgctccaatggtggcttctgggactccttccatagccatcccctccccaactcagtctccagccaccttctctaattcaccacaccaacttacataccagcaggcccaacatttccaccaccaacagcagcagcagcaacaacagcagcttcagatgttttggaccaaccaaatgcaggaaattgaacaaacaattgacttcaagaaccatagccttccacttgctcggattaagaagataatgaaagctgatgaagatgttcggatgatttcagcagaggctcctgttatttttgctaaagcgtgtgaaatgttcatcttggagctcaccttgcgctcttggatccatactgaagagaacaaaagaaggacgctacagaagaatgatattgcagctgcaatttccaggaccgatgtttttgatttcttagttgatattattccaagagatgagttgaaagaggagggtcttggggtcactaaggcaactattcctgttggccctccggctgatcttccatactattatgttcctcagcatcctgtaggacctccagggatgatcatgggaaagccagttgatcaagcagctgcctatgaagcccagcagccacaacctccagtggcactcatgccatggctg

SEQ ID NO: 17493 - DNA, 493 bp, Populus trichocarpa
  Predicted polypeptide sequence is orthologous to G484
ctaaaaccatgtgctacaaagtaacgtgccttttatgcaataaatattcctggggtgggtgtggcaaccacctcaccgccgtgtatgcgggcatagagaagggaaagcactgcacgtgcaagccatggccgggggttgtcatccttacggaggagacagctgccgagcaacaaccatatagggctttatcagctaattcagctaccaaggctgctgcagatgcagggcatcatcgcagatggtggcgtgcctagtcactcggaactcgatcctaaaaagatgaatgctggggagagagtactacgttaattacaataaagagtcatgttgtgtttgtgcatgaataatggataccgttgcttgctcctaccattttcgtccaagctctgccatatatatatcttctgattatggtcaatgttgcatcgggcaacctgggttttctcatattttcttttctgaatgtatggactaattaataaagaatcaaacc

SEQ ID NO: 17494 - DNA, 844 bp, Populus trichocarpa
  Predicted polypeptide sequence is orthologous to G484, G2631
gatgcctcctttcctcctcttgatctctcattccaccaatacagcaataacacgcacttgcaaatacggttctgaatcggttgactcggtctctgcgctggtagattcacgctattttatctccgtgttttgactctggtttgaacgatttgacgatggaaccgatggatatagttggtaaatccaaggaggatgcttcgcttcctaaagcaaccatgaccaaaattattaaagagatgttacccccagatgttcgtgttgccagagatactcaagatcttttaattgagtgctgtgtagaatttataaaccttgtatcatcagagtccaatgaagtatgcagcagagaggacaagcgaacaattgcacctgagcatgtactcaaggctttacaggttcttgggtttggagagtacattgaggatgtttatacagcatatgagcaacacaagctggagactatgcatgactctttaaaaggtggtggtaaatggagcactggagcggcgatgactgaggaagaagcggcggcggcgcagcaaaggatgttagatgaggcgcgtgcaagaatgaatggtgtggtcagtgcccccaagcagccagaggctaaccaaagtttagagagctagccttagggactttaatttcttgaaccgtaggcaagcatcaattctcccctttgcacgacaagtcttatcatatacagtgtacaaagtcattggcaaagtgcaagaagtgacctctgtggacatgccacttcgatttgtactctttgtttatcttatggatcatgtttataacttaaatgtaattagtgcaagttcgtccaaaaaaaaaaaaaaaa

SEQ ID NO: 17495 - DNA, 917 bp, Populus trichocarpa
  Predicted polypeptide sequence is orthologous to G489, G714
gcagctttcgtttccaatcttaggttcttgatcttgcaagcagagagtacaagctctgcagaagggaaagaggcattaagttgcatattgttgcatttagttggatcagaatggagcaagggcatggacagccccctgctatagtcagtagtacatctcaactgcaatatggaacaagtccgtatcagcctaaccaaatgcttgctgcctcaaatcctggatcagttactggtcagcccgtgggagctcagcttgcacagcaccaacttgcctatcagcagatccaccaacaacaggaacagcaactccagcaacaacttcagtctttttgggcaaatcagtataaagaaattgacaaagttactgacttcaaaaatcatagccttcccttggctaggatcaagaagatcatgaaggctgatgaggatgtgaggatgatatcagctgaggcaccagttatattttccagagcatgtgaaatgtttattttagagttgacattgcggtcttggaatcacacggaggagaacaagagaaggacactgcagaagaatgatattgctgcagcaatcactaggactgacatctttgatttcctggttgacattgtgcctagggaggatctgaaagatgaagtgctagcatcaatcccaagaggaacaatgcctgtcggaggacctgttgatgcactctcttactgctatatgccacctccgcatgcacctcaggttggagctcctgggatgataatgggcaagcatgtgatggacccagctatgtacgcccagcagtctcacccctatatggcacagcatatgtggccacaaggatcagagcaacagcagtcgccctcagatcattagtaactttagaattaatggaaatatccctcctgaaaagtgcagtcaagaatggag

SEQ ID NO: 17496 - DNA, 869 bp, Populus trichocarpa
  Predicted polypeptide sequence is orthologous to G489, G714
ttttttttttttttttttcttttttttttttttttttttaaaaaaaccatgatatttttacatgccaaaaggttaccgtttatccaattatccacaatagctgaactcgcatccttgacaggattggaaatgatgaaatttgaagaggcaataaaaacctgttagcaactgacatgttatggcttgcatacaagtaaaaaccaatcaacccctagcttttcaaccttaaattcacactatccaacatgtttcaactacagctactgcacagcctgctcaggaatcttcaggtggctgctgtgtttgctgtggccaaatctgctgtggtacataagggcgagactgttggccataaaaagcttgatccaccacaggctttcctacagtcatccccggcgcaaagacctggggtgcaagctgaggtggcatgtaatagtaaggaagagcatcagctggacctcctacaggaagactccctctcgggactgatgctaacacctcatctttcaaatcctctcttgggacaatatcaaccagaaaatcaaaaatatcagttcttgtgatagctgcagcaatgtcattcttttggagtgttctccttttgttctcctctgtatgattccaagatcgcaaggtcagttctaaaataaacatctcacaggccctggcaaatatgatgggagcttcagctgatatcatccttacatcttcatctgccttcataatcttcttaatcctagccaaaggcaggctatggttcttaaaatcagtagtctgctcaatttcttgatactgatttgcccagaaagtttgaagttgttgctgcaactgctgctgctgttgctggtggatgtgctggtaagcaagtt

SEQ ID NO: 17497 - DNA, 952 bp, Populus trichocarpa
  Predicted polypeptide sequence is orthologous to G489, G714
ttttttttttttttttttgacagtgagcaaccatagttcacataccataacagaaggatgatgttcatggctcatcaattatcacgtacatataggaaagggaaaaaaacaacaacaaagtctggtcattacatgacaccattactgaaattttcaacatcgactgtcatctccatatatggtttttactagaaaaggagtatgatatgcgtactaaaatctggtagaaaggcaagaaatattggcactatcagttacatgaaagcattcctgtacaacatactcatctgatcaccctggtctcggtcatcaaacacaatccagcggtagataagttaaagtgagcttacacttctgaacttccatgctccagttactactgatctgagggtgactgctgctgctctggtccctgtggccacatatgctgtgccatatagggatgagattgctgggcatacatggctgggtctgtcacaggcttgcccattatcatcccaggagtcccaacctgaggtgcatgtggatgtggcatatagcagtaagggagtgcatcaacaggccctccaacaggcattgttcctcttgggattgatgcaagcacttcatctttcatatcctccctaggtacaatgtcaaccaggaaatcaaagatatcagtcctagtgatagctgcagcaatatcattcttctgtagtgtcctcctcttgttctcctccgtgtgattccaagactgcaaggtcaactctaaaataaacatttcacaagccctggcgaatataactggtgcctcagctgatatcatcttgacatcctcatcagccttcatgatcttcttgatccttgccaagggaagactatgatttttgaaatcagtaactttgtctatttctttatactgatttgtccaaaaagactggcgttgttgctggagttgctgttgctgttgctg

SEQ ID NO: 17498 - DNA, 920 bp, Populus trichocarpa
  Predicted polypeptide sequence is orthologous to G502, G519
gtatgaatccaattataaccgcaacaacaacagcaacagcaacaaggaaactaccataaatctacacatgctactgccctatacacacccccaaaatctaaatccatcagggaccgtctgatcacccctacttactccaattactacataacactagcactcgcacacgcacactcacagacttcagtctcgtgttaccgtgcgatttgcccttaacacaatcaattcccattctgacttcaaaacggcttctgcaggtgcataaatatatcctgaagcggcgacatctgattatccccctgcaactgagacgcaaatggaatatccattgtggcatccaggtaattgtaaggattatcgagggcatttacgtttccccattccttacacctaggctcactctgcacctcgcacgtgaattccggcgacaccacatgctccgagcagctcgaatccgtgtgcatcctcggcacggagtctgacgtgtcaaagtacatgtaatcattcaccgttcctgtcgccgaggacggagcttgtggtggcggcagcaaaacaacctgcttcttctcatcctcctcaatctccgtcggattcgctttcttgacgctaagatgctgttcttgcttctcaactgtacctttcttgttgtatatgcgacagagtacccaatcatccagccttaagctgttcttcttgcgagccgagcgatccacgtcggctagacgatactcgtgcataatccagttcgttttctctcccttaggagctttccccgcgtaaaataccaaagctttcttgattccaactgtcttcggctgcccaatcggcttgtcggctcccgtggctttccagtagcccctccctgcagcacgattcggtctcgatccgttagggtacttcctgtctctcggggtaaaaaa

SEQ ID NO: 17499 - DNA, 760 bp, Populus trichocarpa
  Predicted polypeptide sequence is orthologous to G502, G519
ttttttttttttttttttggcactttagactttcttgaatgtcactaatttttaattaatgagaaacaaattcgtgtccaatccttacaagaatggttacaattacatattaacatgagaaatgctgattaatccaaccatgttctgtcacccttgatcaatcaccagcttcttataatacgtcccagtccaccctataccttctcctccttcccatgtcagatttggacactggcactggcaaaaaggggtttgaatccataccgcgatcgattgaaaatctcaagttaacactcttccctgtaatctggctcttgaaagtggctgtgtagccctgggtttcgtccatgatatatatgtatatataaaaaaatattttctgacactgatcaatcccccaagatttcccacaactgttaaactacatctgcagactccagacaaagattgtcctgggccacatgcaagaatacaacaatgttctatactatttctacctatgaaactaaaatgcaatggccactgggcacacatcaagaaccctattcttttttcttctttcttttctgtgagtaaaatcaaaatggcttctgtaaatacatgaacatgtcctgcaaaggtgagagctggtccaattggaactgatcttgtgaagcaaaagggtaatcttggaagccatcatcaatgtaattgaagttgaaatcgaaggcattatctagctgatcattccattttggctgactctgaacctccttctcgc

SEQ ID NO: 17500 - DNA, 909 bp, Populus trichocarpa
  Predicted polypeptide sequence is orthologous to G504, G1425
ttttttttttttttttttcaccatgaccaataatatatattattggaataattaagaaacttttaataaatataaactgttgtgcttatatacaaggtttaatcgtaaagcagaacaattttatatatatcactgatcaacaattttatttttctataatatcaggatcccacctcctatttttctttgcttccttaataacaatataataagagcaaacatttacagaatatatatgcaactatatataaatatctccatctatatgaattgtatctacggcctcgcttcaaattggcagctacatgtttcatttggagaaactggaggccactgaatgactctctaatctcttcctaacaatcaaaatctcaatgtacctccaatggaaagctgatacaactactaatcaatcgacgaccgtctatataaacaagtatataacttgatcactatttgaatgcttcatattatccactgggaatggattcataggtctaaatataatatatgcatagaccaatgaattaagattagtttaagagtaccagttcatgcctggaatttgatatggtggcctaaaaattccatttcccatagaccccagcattgtctgttggtgcaattgagatgtctgtggaagttgactgagaagagtaactatggaactattcccatcattccccacaacactttcatctccattaatatccccttgaaatctcttacttgatgaagggacagccatgtcctcgtcggtccaatacagtgatgggagtgttcttttgagtggaagcatgggtaggtgatctggcttggatactgaagaagccacgtgagacatagaactgctgcttctgatgccatcattgctgcttattattccctcgaataaattatggtcattgt

SEQ ID NO: 17501 - DNA, 892 bp, Populus trichocarpa
  Predicted polypeptide sequence is orthologous to G525
ttttttttttttttttttggcatagataattcataagataatttcttacaatacatacaacattgttcactgtctttcaatttatcaatttgattcaagaaatctatgcacaaacccacattttaatttcaaaataagtaataacagtaactgacgctcttctttttcttgatcttcttcaacttgaggttcaccttctagtactgtttttcaatagttccagaaacaatcaaggtccattgattggactaatgtagaaggtggtgcctcttgttcatcaaatgacctttttcccgcttcaagatttgatatgacagaagagatttcattgttcatatctgcagcgctatcttgtgagacactggccatgtccctttcaagcttggaactttgctgcttcatgtttgagccttggttctcaatcaaggcttttaaaactgagcggtcttgaattgaaacagaacctggatattgcaaatttcctgatgctgcgacagcctggggagagtagaatgaattcagaagtgggattcgaggaaaaacctctgaagggttcgaagaaactgcaaaaagatgattgttgaagctatcagttgtgtcttgttggtttctttgatcatcactgagattggagaagcagggcacgtaggccgactcggccaccggcttaatcttgccattggagggtgaagaatccgtcaatggtggcagaccataagggctaaattcattaccaaaagaacctagtctcactagacctgaaatataggtcttctttccagccgagctcttttgaaacaccctgccaatcacccattcattcttggcagttttggggagattgtgggcagagaatttaccctctaatctgtattcatgcatgacccagttg

SEQ ID NO: 17502 - DNA, 829 bp, Populus trichocarpa
  Predicted polypeptide sequence is orthologous to G526
ttttttttttttttttttggactaataaaaatctatacaaagtatttatatgatcaatacaaagaactttccaaactctaatcaaattacctagctagctaatggagaaatgactgtttcaaatcacatgtcctcagaaatttttctctctttcttctttttttttcgttacattcatatatcctaagaatttaaagaagaaattaaaccacgcgtagatatacacatattctctatggtcttcaataatcccacaagcaatccaaatctgcaatggggccagctgatggaccctcaagatcttcaaaaaccttatcatggctccctatttcttgctttgaaaccacagatgatatctcagctgtggtgttcacgtctgtgctaagtccagtgtcctgtgaaaggctgaccatagattgattagatgagaagcgctcaaccttgcactgtttctccaatccagatgcttctctataactgtttctagctaatgatcttagaagggtatgttcattgtcactgaagatagagttttgaaagttttggaatgaattagaagaactctttccttggtgcaagtagccaggcatattgggactggtttgaaaggtgtaaagaggatttgaggctggaatttgagggtgaaaactggagtttggtgcttggtagttggtatttggaggttgagcaaagttttgattgttgttgagcatgcttgtattggagaaataatttccatctgatgatcttgttgccatttccttgaactcattgttatcgccaccactgaagctgctggtgcttggcctgctattgtaattaaggggat

SEQ ID NO: 17503 - DNA, 707 bp, Populus trichocarpa
  Predicted polypeptide sequence is orthologous to G536
tccgtctctgcaaatctctttccacgaagtaacttttagtttgatatataaaggatgtctccaactgaaccatcacgtgaagagagtgtttacatggccaagttggctgaacaggccgaacgttatgaagagatggtggagtttatggagaaagttgcaaagacagtcgataatgaggagctaaccatggaggaaaggaacttgctctccgtggcctacaaaaatgtgattggagctaggagggcttcatggaggatcatctcttccattgagcagaaggaagagagtaggggaaatgaagatcatgtgacaatcatcaaggagtacaggggaaagattgaagctgagctcagcaagatctgtgacggagtcttgagcctccttgagacacatcttgttccctctgcctcagctgccgagtccaaggtattttacctcaagatgaagggtgattatcacaggtatcttgccgagtttaagaccggggctgagaggaaggaagctgctgagagcactttgttgtcttacaagtctgctcaggatattgctctttctgaactggctcctacccacccaataaggctggggcttgcacttaacttctctgtcttctactatgagatccttaactctcctgatcgtgcttgcagtcttgctaagcacgcttttgatgaggctatttccgagctggatactttgggtgagga

SEQ ID NO: 17504 - DNA, 937 bp, Populus trichocarpa
  Predicted polypeptide sequence is orthologous to G536
gaaaaccacatctctctctctcccccccaatcttctcactttctaaaaaaaccataacaatggcagccacaccatctgctcgcgaggaaaatgtctacatggcgaaactcgccgagcaagccgaacggtatgaagaaatggtggagtacatggagaaagtctccgcctccatcgacaacgaggaactcaccgtagaagagagaaacctcctctctgtggcttacaaaaacgtgatcggagctagacgtgcttcttggaggattatttcctcgatcgagcagaaagaggagagtcgtggtaacgaagaccatgtgtctgtgatccgtgactatagagctaagattgagaccgaactgtcttcgatctgtgacgggatcttgaagttgctcgacaccaggttgattccaacggcttcttctggtgattcgaaggtgttttatttgaagatgaagggggattatcacaggtatttggctgagtttaaaactggtgctgaaaggaaagaggctgctgagagtactctcactgcttacaaatctgctcaggatatcgcaaatgcagaactggctcccactcacccaatccgtctcggattggctcttaacttctcagtgttttactatgagattctcaactctccagatcgtgcttgcaatcttgccaaacaggcttttgatgaggcaattgctgagctggatacattgggcgaggagtcatacaaggacagcactttgatcatgcaacttcttcgagataatcttactctttggacatctgacatgcaggatgatgctgctgatgagatcaaagaagcagcacctaaaactggtgatgaacagtgaaggtgctttactgcaaactagtgttgaacttctctatatgtttttaacaggagatggtgcttgttgctaatttgcttgatttgtaggcattctta

SEQ ID NO: 17505 - DNA, 929 bp, Populus trichocarpa
  Predicted polypeptide sequence is orthologous to G536
ttttttttttttttttttcgtatataagattatgaagatcatttccaaaaaatacagtacaacatcgttaattttgtagtcggatcagaattggataggggggaaagccaaaataaccaattgaaaaataattgggtccaagaaatttgaaaaagcagcaatagtcgttggctaccaatattataacccaacaaatatttctgctaatacatagttgactgaaacagggatcaacaccaactgagataaggtactacaaaaatccttttgaaataaagcaatagcacaacactaggggaaatcatcctactcccattcacgctttcaaggaccagaaggttatattagcacggtcactcggcatcttcaccctcaccagttctggcggaggtttccatcttctggtctccatcctcaggaatatcagaagtccacaaagtgaggttgtccctcaacagctgcataatcaaagtgctgtccttgtaagactcttcactcagggtatccagctctgaaatagcttcatcaaatgcttgctttgcaagatggcaggcccgttcaggagagttcataatctcataatagaacacagagaaattaagagccaggcccagtcgaatgggatgggtgggagaaagatcactggctgcagttgttgtagcagtctcatatgccttaagtgactgatcagcagcctctttcctctcattaccactcttgaactctgctagataccggtaataatcacctttcatcttgtagtaaaacacagtggattccccagctgtacatgatggaataagatgctcatcaatcactgtcatgatatcatggcaaatgcctgttaactctgcttccaccttctgcctatactccttgatcctcttcacattcgtctcattccctttcgactcttccttctgctcaat

SEQ ID NO: 17506 - DNA, 951 bp, Populus trichocarpa
  Predicted polypeptide sequence is orthologous to G536
ttttttttttttttttttggcaaaaacaaaagctacataattaaaatatacccaaatcaaatgctaccctttccaacgcacttgaaattcaaaagcaagttaaaaatagtagtctaaataagaaaccatcatgtcaaatgggtgatgcccgattctcttaaattaacacactttgcaatcagggaaaatggatgacattcaaagcccacctcctcctgaagaagactaacactaggaccggtcgaacttatgaggccttctatggctcatctaactggtcctggacatctgatgtccaaagagtgaggttatcccttaggagttgcataattagagtgctgtccttgtacgattcttctcccaaagtgtctagctcagcaatagcttcctcgaatgcctgtttcgccatgctgcaggctttgtcagactggttgagaatctcatagtagaacacagagaaattcagtgccaaacccagccttattggatgtgttggtgcaagatccgcggccgcaatatcctgagcagccttgtaagacaacatagtatcttcagcagcagcctttctctcatcaccaaccttaaactcagccaaatacctatgataatcccctttcatcttcaaataaaagaccttggattcactcgcagtagcagatggtatgagattcgagtccaacaacctcaaaatactagcacaaacatcagataactcgctctcgactttagatctatattccttaacaaacacaacatgatcctcgttctttctgccttcctccttttgctcaatcgaagacacaatcctccaggcagcacgaagtgagccgatcacgtttttgtaagcgacagagaggaggttgcgttcctcaacgttgagttcaccgccaggtgtgttgccgaggaccagcttttgcatgaactggaccatctcctcgtagcgttcggctt

SEQ ID NO: 17507 - DNA, 835 bp, Populus trichocarpa
  Predicted polypeptide sequence is orthologous to G536
ttttttttttttttttttgttacaatctgtgaatttaaaagcaaaccacaatcattccacttgcaagtgttctaagagaaaagaaggcataacagtcttaaaacatctgttcagcaaatagatacaagccaacggtccaccattccctgtactaccactgaaggagtcattctggcattttaaaagatttgatctccacgatcctgactatttctctgccctgggttcaacagctgtagagtgctcgcctccttcctcagacagatctgaggtccataaagtgagattgtccctgagtagttgcatgataagggtactgtccttgtaagattcctcattgagactatcaagttctgcgatagcatcgtcaaatgcttgtttagccaggtggcaggccctttcaggggagttcaaaatctcatagtagaaaacggaaaagttgagtgccaggccaagtctaattggatgggtaggaggcagatctgagatagcagtagaggttgctgcctcataagacttaagggactgatctgcagcttctttacgttcatcagcacttctaaattcagctaaataacgataatagtctcccttcatcttatagtaaaagacagttgattccccagttgaggaggatgggatgagatgctgatcaatgactgataatatatcattgcagatctttgcaagttcatcttcaaccctctgcctgtactgctttatcctcttcacattctgttcattccccttggcctcctccttctgttcaatggaagatagtattctccatgatgctcttcttgcgccaatgacattcttgtaacccacagacacc

SEQ ID NO: 17508 - DNA, 847 bp, Populus trichocarpa
  Predicted polypeptide sequence is orthologous to G536
ttttttttttttttttttggcatgaaaactctattcataagtttatttctagaaatccaccgagatctccagcatgatatcctgaagagatggtaatcactgaatacaagatgaattctttacccaaaataaccaattgaaatataattggcctgcaaggaaatatgaaaaaccagcaataatcgtaggccatcaatattacaacccaacaaatattcctactaatacatagttgacggacaaagagactaataccaagtgacaatagtaaggtacaacaaatgagaaaatctcaaaaacctctcttgaagtatagcaatgacacaacaatgtgggaaaatcatcctactcccatttactcatcagagttccagtcgcatcatcactcagcatcttcacccccaccagctcttgcagaggtttccatcttctggtcttctccatcctcaggaatatcagaagtccacagagtgaggttgtccctcaacagttgcataatcaaagtgctatccttgtaagactcttcactcagggtatccagctctgaaatagcttcatcaaatgattgcttcgcaagatggcaggcccgttctggtgagttcataatctcatagtagaacacagagaaattaagagccaaacccagtcgaatgggatgggtgggagatagatctcttgctgcagttgatgtagcagtctcatatgccttaagtgactgatcagctgcctctttcctctcattaccactcttgaactctgctagataccggtaataatcacctttcatcttatggtagaacacagaggattccccaggtatagatgatggaatgagatgctcatcaac

SEQ ID NO: 17509 - DNA, 931 bp, Populus trichocarpa
  Predicted polypeptide sequence is orthologous to G536
gagacaggagagcgagaacgagagagatagaaagcatggagagggagagagaacaacaggtatacttggcgagacttgcagagcaagctgagagatatgatgagatggtagaagcaatgaagaaagttgcaaagttggatgtggaattgacagtggaggagaggaatctggtgtccgtgggttacaagaatgtcattggcgctagaagggcatcgtggaggatactttcttccattgaacagaaggaggaggccaaggggaatgaacagaatgtgaaaaggataaaggagtacatgcagagtgttgaagatgagcttgcaaagatctgcaatgatatattatcagtcattgatcagcatctcatcccatcctcttcaactggggaatctactgtcttttactataagatgaagggagactattatcgttatttggctgagtttaaaggtgctgatgaacgtaaagaagctgcggatcagtccctcaaggcttatgaggcagcaacctctactgcgatctcagatttgcttccaactcatccaattagacttggcctggctctaaacttctctgttttctactatgagattttgaactcccccgaaagggcctgccgcctggctaaacaagcatttgatgatgctatagcagaacttgatagcctcaatgaggactcctacaaggacagtacccttatcatgcagctacttagggacaatctcactttatggacctcagatctgccagaggaaggaggtgagcaatctgcagctgatgaacctaaggcagtgaattagccgggattgtggagagcaattctttaagattgggttagttgaagaagggaggaacatgcgagaatgactctcagtagtagtacggggaatggtggaccattggcatgtatctatttgctgaacaaatgttttaa

SEQ ID NO: 17510 - DNA, 943 bp, Populus trichocarpa
  Predicted polypeptide sequence is orthologous to G536
gagtttcttcccctccatttcacgcacagagagagacccgtgtctgcagattctcttttcaagaagtaacttttagtttgatataaaaatgtcgccaactgaatcatcacgtgaagagcatgtttacatggccaagttggccgaacaggctgaacgttatgaagaaatggtggagtttatggagaaagttgcaaagacagttgattcggaggagctaactgtggaggaaaggaacttgctctccgtagcctacaaaaatgtcattggagctaggagggcttcttggaggatcatatcttccattgagcagaaggaagagagcagaggaaatgaagatcatgtcacaatcatcaaggagtacaggggcaaaattgaagctgagttcaagacgggggctgagaggaaggaagctgctgagagcactttgttggcttacaagtctgctcaggatattgcacttactgaactggctcctactcacccaataaggcttgggcttgctcttaacttctctgtcttctactatgagatccttaactctcctgatcgtgcttgcaatcttgccaagcaggcttttgacgaggctatttctgagctggatacattgggtcaggagtcttacaaggacagcacattgatcatgcaacttctccgagataatctgacactctggacctctgatatcacggatgatgcggacgagatcaaggaagcatcaaaacgtgaatccggcgaggggccgcagtgatgaagttcagttcataggatatatgcactctgtacttctatcttgtgaaatttacagacgcctgtgggttgttgtagttggatttattaatgaatttgataatcttgagtgccgtgccacagtacttgggattgaaatgtaccaacagattatcaagtttttagtattgatgcctacaatctgggttgatgtttt

SEQ ID NO: 17511 - DNA, 718 bp, Populus trichocarpa
  Predicted polypeptide sequence is orthologous to G550
ggcttattggggttgtactgtaccaggtgcttggaatgtcccttggcttcctcaaccatcttctccaaaacaaacctcctcgagctctgaccctaactctccaaccctagggaaacattcaagagatgaaaacttgctcaaacctagcaactccaaagaagagctggtgaacactgaaagatgcctttgattcaaaggttgagaagaatcgcgcagccgaaacctctccagtcttgcacgctaatcctgcagcattgtctagatctctcaaatttcaggagagctcataattcgggtagctttaacttgatatttgttccgagcagtggaaacaagttctggtgtttcaactttaacagcttcataaactgaaggtttgcagttcagtcactggcatcatttgtcaatggtctccttgcagtcgatctataagaggaaagagcagaggagaagagaactatcctagctagcagcagtagccaccgttaggtatttatctttttgctggaagcagtccaggacggtgcttttggatgtccacttacatggttttccaagttaatgtacatatttatatatgaaatagtgagaaagtgagagcttaggaaagaattgagtttgtgtagcataagaatcccttttgtactaaaataaatttgggaatggaaatccaacctcttcgtttttattggggcaaaaaaaaaaaaaaaaaattcga

SEQ ID NO: 17512 - DNA, 514 bp, Populus trichocarpa
  Predicted polypeptide sequence is orthologous to G550
gtttttttttttttttcttgcgaattacttgtatcactatcttcttcttctgtccttgaagtttgcaatccttcactctccttctcaatggaaggtgttttagggttttcacttgtccctgaggttgcatctggatttgaaggctcttcagtagccacgggtgaaactccatcttcctgtttctcagtcaggcttttttccaccgagtccttatcatcagcttctatatcttcttctccatgataactcttattattatcagaatcggcgtcataaagagaagagcttgcacaagatggacggtcttgatcttgactatcatcattatctgtagtggtagtagaagagatctctgtcacttgaatagtcttcccaaacagcttaatagccgggtcttttggctccaacatttctgcctgctgctctctgcgtcttttttctctttttttttcaactaaaaaaactgtaagcttctagagagagttggtatttttagagagagaaagtgtgtcaa

SEQ ID NO: 17513 - DNA, 888 bp, Populus trichocarpa
  Predicted polypeptide sequence is orthologous to G551
ttttttttttttttttttgaacattgtccttcatatatatatatcataataacagctagctagcccgatatttaagagttatggagcaggtgatgaagtgattatcaaggataagatggcaaaagagcccagtaaggagatgaaactgggttgtattcatccacattgagaagatagttgcagtgttctgcgttgttctgatggtgactgtgtcctcgtagcttgcgacttgctgcagcaactgatgtgctttctactgtctcttcccctgatatctctgtgtaccctgctgttgagacttgcttcctcgtggcttgttctctcaccactgctttcagcttcattacctcttcctgaagcttctgtttctctttggacacagaatcaaactcctgcttaaggttgtcatataagcgctcgagctgtttagctttccatctagcacgtctattctggaaccaaacagcaatctgcctgggctggagccctagttcacgagacagcttcattttcctatcaggatccaacttgatctcttcttgaaagctcttctccaacgactctaactggtcacttgtcaatcgcttcttcttctcttgactctcatagctggtgatcttgtccagagcggttgggacgaatctgttgggtgcattttctgctaatattgctgggtgcttcatgtccatgcctggatactgcgggtcataggcatagttgtagaggaagttaaaggaagtctgatctggtcgagaaacaaagcttctgaagttgccattccaatccatattatccatattcatattacgattactagctagctactctttctaatctgtatataacgacgtttgtgttatacctgttgttggccagtaaattaaggac

SEQ ID NO: 17514 - DNA, 797 bp, Populus trichocarpa
  Predicted polypeptide sequence is orthologous to G558, G578, G629, G1198, G1806
tttttttttttttttttttttaaaccagaaagactcgaaactgtagctgatttatgaactcttgaccattatacaaatttcaaggttttatggaatctctatgttatagatgacaaatataaaaacaattagaagcatacctggcgaataaatccctcaagggtacctagctttcccatggccatggccatctgacccatgtaatttgccacatttccagatggccctgaggagccaagagatccgctggacaaagtctcagagagggactgctgcaatgcctccatcccttgagataatgcatcttccgcctgttgggaggactgctgtaagttgccaatgcccaccaactgctgctctgttaaaggctccaattgattcataagaagcttgaggagctcagatgaacggaagccaccaagccacaagaaacacctctctgcaggtgtcttccacatgccagacagcaaatggaaaacatcagccttggctgcgttgctcttcagcttgaaaacttcatcatagtgagccattataccatcagtgatataccgaagttctgcatcaccagcatgagaattgacagctgatctcaactcattaatttgtcgattttgctcctccagccatcgtgcatattctacatcaaatgccatgggccccatttccactcattgaatgagtttggtctcctgagcttgatatgaagattccctgctgccgtgcccgttggagctctgtttcagttggctgagcttaagcggctactctcagctgctggaatatgctttcttcct

SEQ ID NO: 17515 - DNA, 875 bp, Populus trichocarpa
  Predicted polypeptide sequence is orthologous to G558, G578, G629, G1198, G1806
ttttttttttttttttttggagtacaaacatagcctacatttcaaatgaaactttctaacacttttaactatacatcctgcaccgagtatcaacttaattacctaaatttgctgcttcagacacaaatcattacgattcatatttacatctgctttggaaaaacatataactggatcgaatacttgtccgtattacaaatgccacaagaacccgttcccctgcagagggcacaagtgctggtggggatcaatatagatatagtggttttctagggtcatacctctgctgactaggcaggttcacaaggacgagcagcccatagagaactgagagtacgaagacggtggaagtactctcctaatgcaagtaaacctcgggctgcttggcgtattgttaagatccgagacatgtggtgcagagtttgttgccgaaggtgatcagcctggttcacaaatccctcaagctcgtcagccatcttatccccataacccccatcacccattacatcagctgctatgctttgggacagagtctgctggagtttatcaattccttgagttagagcatcttcagcttgctgagaagattgacgaaggttacagacatccgcaagctgttgatcagtcaaaggctcaagttgtgacatgagaacatttagaagttctgatgggcggaatcctccgatccacagaaagaagcgttctactgatgttctccattttccagaaatcagatagaagacatcagccttcgcagcatctgttttcatgcggaaaagattgttatagtgattcaagccattctcaactaggatccggagctcaatatcagttatacgagcttgcaatgcattcctaagttcagaaatttgttt

SEQ ID NO: 17516 - DNA, 905 bp, Populus trichocarpa
  Predicted polypeptide sequence is orthologous to G558, G578, G629, G1198, G1806
ttttttttttttttttttgtcgaattattgccactagatgttttataacaagaagataagcatacatctgtgtgagcaaacctggcgttacaactgcacatgaaacctataattacaccaactatggccgctatttgttttacagcaagaagataagcatacatctgtgtgagcaaatctggcgttacaactgcacatgaaaccaataattacaccaattgcgacctatccgcaccacaattaccaccgatgatgatgactaagaccaccagcggcagtccacccaatggcatgatgagaactgaaggccaagtaggagggtggtgaagtggtagatattcatgttaattttgttggggggcaacatactgctactcattcctgtggccgggccaaccagagagaactaagggctcgtagcctagagaaatagtcatgtatagctagaagagcacgggctgattgccgagttgtcaatatacggtgcatttgttctagtgtttgctgcctcagattatcagcctgacgaaggaatccctctagagttcctagctttcccatggccatggccatttgacccatatagtttgccacgttcccagaagaacctgatgagccagggttgccattagccaaggtttctgccagtgattgctgcagcgcttccatcccttgtgagagagcatcttctgcctgctgagaagattgttgcaagttgtaaatgcccattagctgttgctcagttagaggctccagttgattcacaagaagcttgaggagttcagatgagcgaaagccaccaatccacatgaaacaacgctctgctggtgtcttccacatccctgataggatgtggaaaacatcagcttttgcagcagtgcctttcagcctgaaaacatcactga

SEQ ID NO: 17517 - DNA, 574 bp, Populus trichocarpa
  Predicted polypeptide sequence is orthologous to G559
ttttttttttttttttttaagcttagaattttgaatcaacaaatcgccatcaaaggcccatgattgcatcaaggttctacataaactataacatgttaaatgcttaagctataaactcaatcttcaaggaaactagaatatagaacccgcctaaattaggtatgaatgtaatgtatctaaaagactggagataaaaggtaactgtcctatgtgacaacagattgtaactaggatgtaaacaacagtagacagaacatgctgtagttggtctgatgatcatgctattctcagtcctttgatgaagaggaattatcctcagatgaattatctttccggcttgaagaagccattgatcctctcatttgcaaatccccaccttgtttctgctgctgctgaagttgttgctgttgaagctgatgcagctggaactgctgctgctgctgcttctgagaatgaatttggagttgttgaaactgttgtgcagctaagaaagtatgcattgcttgattattgggatataattgctggcctcctccaaaagatgcatagtttggcacttgaccagtcagtaccc

SEQ ID NO: 17518 - DNA, 627 bp, Populus trichocarpa
  Predicted polypeptide sequence is orthologous to G559
ttttttttttttttttttagaaacagaggtgaccaagcacataaacatcaataagaacttgcatgtgtaaacacccatatcggacaggaagtagagtttgaagggttttggtgaggtacaactgaggacaaacctatgaatttcgaatcaacaaatcgccaacaaaggcccatgattgtaataaaggttctacatagactataccatattaaatactttaagcaaactagaatatagagctgcctaaaagaaatgtaaggtagaaatgtaaggtaatgtatattagaaggactggagataaaaggaagggaaaatatcctatgtgacaacagattgcaactaggatgtaaacaacagtagagaccattaagtagctgccttctctttttcaatccttcgatgaagaggaattagcctcagatccattatctttctggcttgaagaagtcaatgatcctctcattttcaaatccccaccttgttgctgctgctgttgctcctgctgctgttgaagttgttgctgctgaagctgatgtagctggaactgttgctgttgctgctgctgctgctgctgctgcttctgggaatgaatttggagctgttgaaactgttgtgcagctaagaaac

SEQ ID NO: 17519 - DNA, 916 bp, Populus trichocarpa
  Predicted polypeptide sequence is orthologous to G561, G562
ttttttttttttttttttggcaagagcatgtcttgtatagaagcacgatcttctcgagctcatatcaaagagtgtccacgtcactatttgatacaattgcacaaacagaaatatttataaatcactagttcccaaaccttccctgaatgagtttctaattctcttcaatgtacattacctttcaatggccatcccagcactgaatattgataaaaacgcatcagttctgccatgagagagctaccttaacatgttaaaattaagagtctcgaggatcggcgccaatcctatttagatattctatcaacagctaaactattaaccgtaattttgggcttgtaattatgccaaaactacatggttgctttgaaatataagatgagggactgcaagcaaactactttcatcagccagcagccacagcatcagctctggggcttgcatccatgagttgatgtagcttggcaccagagttggagcttcgctgctcatcaatgttgtttaaaattatttcttgcgtgggtcctagttgcgcattcttgagtttctcctgctaattgaaccactcgttaatgctgcattttcaagccttagtttctgcgatttctctgtaaactgatctatttctgatttgagtgtcatgttcactgtagtcaacgtttctactttgtgtgcgagttcttcagcctcggcctgcttccttaatcttgaccttctagcagattctctgtttgattgcttcctcctctctcgtttcagctcccggtcattcggtgaccaggcttcagaaggcagcatggcaccaggttgaggaatagttgcaggatttgtcttagcaacattcacactaggagggtttctgagctccaatgctttggtcataccaggatcaacaactgcacccaaaaccttgtca

SEQ ID NO: 17520 - DNA, 893 bp, Populus trichocarpa
  Predicted polypeptide sequence is orthologous to G568, G580
tcgcatggcctcctgatccgtgtttccttgtaaaagtatgtgatcagtggcaggagatcaaaatataaataaaaacagcatgagcaccaataaagtctctagtaattctccgtcaaaatccctctatacatgttcatctccttcaactctgtcgtctccttctccaataccaaaccaatcaacgactggaaactcaatggaagaagtttggaatgatataaacctagcttctcttcatgaacatccaaatagccacacaggcagcaacaacaacaccgacgaccatgtttttcatggtatgatgtttcaagacctcttggctagatcttccaataaagacacaccaacaagggttgcctctaaggaaccctcatctggtgggggcaacaatttcttgaagaactctttagggccgccaccagctactatgctgaatttgaattatggaaaaaggcctcaagaaaacgatgacgtttctggcggcgatcggaggcatgagcgcatgatcaagaacagagaatctgcagctcggtcccgggctaggaagcaggcttacacgaccgagttggaacttaaagttgctctgttaggagaggagaatgccaagcttagaaagcagcaagaaaggttcttggcagcagctcctgctcagccaccaaaaaagcacaccctctatcgaacctcaacggctccattttgagaagtaagaaatttatgcttagcccatttactcctttcatccctttatgtttccacttggctatcttgccaaaaacttccttgaaaagagggagatgttttccatatatcatttcaaagggcttttgatgtaaaagaaaggaggggaaaagagaggtaggaaagtagcaaggacaaattaaagttgcctggac

SEQ ID NO: 17521 - DNA, 912 bp, Populus trichocarpa
  Predicted polypeptide sequence is orthologous to G583
ttttttttttttttttttcttttttttttttttgaaaaagggatgattgcttcatttattccataaacacataatttggaggtagacatggaaaatagagaatagaaaacaagcaaaacaatcggcttttgatcatgatatatttatataatatgaacagccataaccatgatctttactgttattctagtcttccaagaagagcagatttcaaggcctcttcggttctcagtccatcaggaaccctaactaccacatcttggagcataagctcgttaacacaggacatactagcatggtgaacctgaaactccagttcacggagtgcacacattaacctggaagctggatagttcacattctccgattggactctaatcattgcatcattacccacaaactttacctcaacttcaagtgcaagcccagcgccaccagcactattcggcctgcaggctgattggtccacagaagtggtggtgctttgattgtccaaattatcggcaacttccaatttcactttcttggattccctttctagttgtgactctaattcatcaaccttcgccttcaattcattgatgtaggatacagcatcagataatagtgatgctttgtccattctagacacgtttgggaccaccgcacgcagcgcgtaaaaccggtggttcaacttctctctccgctgcctctcagcctctacatggttcagtggggcgtctctgcccaggccaggctttctccctcttttctttggaattcttttctccatatgcatagcaagtagaggaaagtccgagtctgaatgctctgagttcaaataagacaggcctggtttattagcgttacgtttatttgcttcttctgtttcacgagcgttcttctgttcacgatcaactgcacaatcttctt

SEQ ID NO: 17522 - DNA, 765 bp, Populus trichocarpa
  Predicted polypeptide sequence is orthologous to G585
ttttttttttttttttttgggtacaagctgaaccattgaaataaacataaatgttcggaataagtgcattttctgtttattggactcctctacgtggaggaaattctatgttcaatagctccgatctatgaagccctccacaacacagaatcttacgactgaagcagtgaatactaatcatacagtcatcgatttgaaaacaagttcccagcaactatttgaagggcatgtttgattgtgccaactgatgcagcattcaaacccttgtgctttgatttgatagtcagcgaaagaatcccgtccatgatggatgattgaactgagtgagaatctaaatggagatggctcgctgcatccaatatctcgagcaatattccctccctccaaagacacttgatctcgattagaacatcccctttattcatgctgacagttatatggtcagctgaaccatcttctgatatgttatggttggtatctggctccatttcatcaatgtcaggagccttcctcttatttgtcaacgaatttttaccatttccaatcttattgctgccgcagttatcagatgtcctctccacagtatcttgaggttttcttttggttattgcctctaaaagctccctcctacattccaactcttcagcctttctttcaagctctttaaggtattgaattgtgtcatctagtatagatactttatcaaccttgctgattgaagggacaattgatttcagaatcataaaccttttattcagtttttcc

SEQ ID NO: 17523 - DNA, 584 bp, Populus trichocarpa
  Predicted polypeptide sequence is orthologous to G592
gctgagagggtgagaagaactagaatcagtgaacgaatgaggaaactccaggatcttgtacctaacatggataagcaaacaaacacatcagacatgctcgatttggctgttgactacatcaaggaccttcaaagacaagtccagacactttcagagattcgtgcaaggtgtgcatgcataaacaagcagcagcagcagccctagtcgaaaaggtcgaagtatgaatattagtttatgtgtatagaaccaataagaatttgcaagacaagagatgaaggcaaagctgggttctctcttgcactgaaaaagatgaagatactgcttatagccagggagggctacatttattatgtggggatgggagtgaagatcgaatgccccagaagctaattaactataagatattaagattcatccaaccccaaccctatgttgcttattgattaaaggcttggttttttatgcggctgtaccgtatttttttagctttaaattaatattttttagtgtttttttattattttaatatgctaaatgttaaaaataaataaaaaatatattattttaaaaaaaaaaaaaaaaaa

SEQ ID NO: 17524 - DNA, 867 bp, Populus trichocarpa
  Predicted polypeptide sequence is orthologous to G592
gttactgttcaaaatggcttgttgtcacagatttctgaaattgggagcgaaagcatggaggcaggcagccctgacagtggaaaactctcaagtgtcagtgttgacagtcgattttatagcagtcacgggtttccgtatggttcttggaatgattcgcatttgtcagagaactttagcagcatgaaaagagagcaagaaaatggaaacttgttttctaatgctcagaacggagaacttggaaatcgggctcatgtattatcccaccacttgagtttgccaaagactgcaatggaaatggttgccatggaaaagtttctccatttccaagattctgttccttgtaaaattagagcaaagcgtggttgtgccactcatcctcgaagtatcgcggaaagagtgagaagaactcggatcagtgaaagaatgaggaaactacaagagcttgttccaaacatggacaagcaaacgaacacagcagacatgttagatttggctgtagtgtacattaaagaccttcagaaacagtacaagacactaagtgacaaccgagccaactgcaagtgtttaagcaagcagaagccagtgcaaaacagaattgtttgaggtgcttctgtacagaaatccaaggggctgttcgaccagttcttgttgatctttagcatcagtaagcaaagataaatattttttttttatgtagcaagtttggtagaaatttccaccctcatgttctgatcctgaagctaacaaagcttccaattactcaatacctgaaaaaaagccataaatgtacagaacatgttgtaacgcatcaattccttgttatgaaaagataaatgcattaattcctaaaaaaaaaaaaaaaaaaaa

SEQ ID NO: 17525 - DNA, 814 bp, Populus trichocarpa
  Predicted polypeptide sequence is orthologous to G592
ttttttttttttttttttggcaatgcaataacaaccttgcttaacacatcaaaagctacaaacaggaaaacacaatccgaagatgagctatgaaagggcactgcttccggtaccgtgtaatgagatcagcagtggtacagaatattgcagtgaaaagtgtatctacttatccttgagagttcacaatctccgataccctattattttacagaagataactaaggagctatgctttttctttttttttttcattttcctagtgctatctgtacagaaacaaaatcaagctgaggtacttgaatattatttctgtttacttgaacacgtgcacttagctttagtatccgcgagagtcttaacttgtttctggaggtctttgatgagctcaattgacaaatctagcttatctgcggtgcttgtttgcttatccatgtctgggaaaagttcttgcaattttctcattctttcactaatccgagttcttcttacctccattatggccacttgtaccattcacaaggctctcaaggaatgagcttggagcagagcgataactcttcagacctgagttttgctggatttgttgttgttgttgatgatggtaatgataaagatttaaatccatgaattcttgactctttctcaattctccatctgaataattgaaactagggctatacaaaagactcatgtcttcttctgaggatccctgaacaagatttaaacacttctaaattgtcaattgctttgcttgctgcagtacttggacctctaacttggcttaaacttcaaagttgcttgtcctcagtttttc

SEQ ID NO: 17526 - DNA, 802 bp, Populus trichocarpa
  Predicted polypeptide sequence is orthologous to G597
ttttttttttttttttttctctcctcttatttattaacagttgacttgaaatacaaatgggactccgaacctctttagagtccacgcgtagtactacactaattagtcaaaaagctaaaaggatttatttccatggcatgtttgatatgccttgggggttgttattgcaggctccagtactctggttcagtggactaccaggcccacctgaagattcactgagagtcccacgtgacggtgggctgctcaccccaatcgatccaccagttgggggaagctttgatgttgcagatgaaagttccatgtggtttgctgactttgataccttgcgaccatctgcaatgaaactactcacaaccacctgtactggggctgcagccattagaagaccagccacactaccacctagcacccgaccatctgggccagacaaacacacccttagacctccagtcctgctccttcgacccccattttctgatggcagatatgaaccagaaagtgccagaatttcaaatcttccctcataagttacagttcctccagatgtggcctgttggcgaagagtcacattggatatggcaccatttgctgacaagatacaaacagcccttggaccatgctgagaaaatgacataatcttcgacgatacatccaaaacaacaagttggaaagaaaagcaaaatgttttctacgaggaaagaaatactacgaaagctgaagtatcaacgacatgagttatgagtaagatatcagaaacacgatcatttgacatataagcaatcttaacaagttcagcact

SEQ ID NO: 17527 - DNA, 867 bp, Populus trichocarpa
  Predicted polypeptide sequence is orthologous to G598
ttttttttttttttttttatccttttaggacaagtatatctattaactaagcaccattttccgtcaataatatgaagcaatacaactgcacaagataaaaaggttgttccaccactattaccaacaggcccctcaaaattctaagcacacttacaaagttcaagcactcaaaaaagacacataataaccacccaaatcaatacttttgcagcttcgagtgctactcttcactgccccattttggatagggtgccctgctgttcaaaagatgcagggccctaacagtttggagcaattattgtggacactgttttttgtttgaaaatgtttcaaggagtactattatgtggtgctattaattatggctcaaaagaaggatcgtttggcaggagctctgccgacagctctcatcaaattggctacttcaagaactctagcaaccttggttcctctcttagcttcagctgatgcccttctctcctctgcctttctgtgtgcctttgctacctcattttgcatcttctctaaggctcttgctcttttctcctctaacttcctctcaaccttcttcatccaagaagtagacttttgcacctgctcactctcccacccattaattacagcatcttctctcttgagcctattattgatctttgcaatctttgcattttgccatgcagttatcttagtctcaacctcctcttttttcactctcatcaccgacacttcaccgccatggctaccactacccacacgaccggacccgagccttctcgagcttggttcggggtctgaagggttgttgtcgggcacaatagccaaagggttagtttcttcaggcacgtcatgatcatcctctccaattct

SEQ ID NO: 17528 - DNA, 837 bp, Populus trichocarpa
  Predicted polypeptide sequence is orthologous to G600
ttttttttttttttttttactattttatatgtacgaacgttggcgcctgtcgacgcatacgcattttgtttatcttgctttatttcatttgataatcatataaaaatatattcatataattcataatgcattgcacattggattcattaaactttgattattttttttactttatttcatattatttttttatcaatgtatcgaatagacgtcgcttatgtcacgcatttatgagcatatccatggcagaaaagtggtcgacagcactcagtatgataatagcaatgtccaccagccggcacacatgaaggtgttcgatcattggatgtagctgctgttgtcacttctggagttgttgattcggttgatgctgaacatttctgcacaagttttgagcaatggttcgaacagcattgctcagcactcgaacacaaattgccattcgataggcaattcatgtttgcaatgccgttcgattcggaactcattggaatcgcttcattagttggagtttgtagtgtggtcgatgatgatgccattggttttatatgctgtaccgattgaatactttcatttgcttcggctccaaatcgattgatcaatggataaccaattgaagcggtccgctggatcacgtttgattgaatacatttgtatgagtatgtcaagcaatacaaattctggcagcattgagagctcagttgacaatattgtccgacacctttgcattgttgattgctttgaccgcaactaaattgcactgaaatcaacagtgcaacacaaacttttaaccataacattttctgctggtgcaatagaaaatctaaataacaattc

SEQ ID NO: 17529 - DNA, 779 bp, Populus trichocarpa
  Predicted polypeptide sequence is orthologous to G600, G2768
ttttttttttttttttttacttccctgcctcaccaggagccagcttctgctgaacttcttcctcagccagtggagcacttccttgcgaagctggctccttcacacttattgactcatgagtagcctcagatacatccacagctttagcagtcctcactttctcagggacttgctgagaagtaataagaggcttctcctcctcagctattgccttgtttaaaattggagattcttcattaacaggagacggcttatgttctcccttagatgcagcagactgtgtgggtgatggaatctttggaggtggacagcgtgcagactccatatcttgaacttgaaaggcgcttcctacattttcagcactactgttaccagactccaaaatacgattgattgtatccctgagagtcttgttaggaagaagatcatctgcaaggacatttgataccccacatacacactttgactttgagataatgtaatctcttatacacttgtcacagaagctcgtgaaacaacatttgcttgttaagactgcatctttcataacttccttgcacagtgggcagtgaagttcaggtggaagatcaccaacaggccgtgtggaaggtaggccttcaatttctctctcaaaagcagcctcatttggcttcaaaacagcaactgcaccactaggtaaagcatatgagccatctggggtagccatcagcattgactttggaataccagtaggtggctttactcttttaattcataattagggtcaccatttgtagggc

SEQ ID NO: 17530 - DNA, 802 bp, Populus trichocarpa
  Predicted polypeptide sequence is orthologous to G600, G2768
ttttttttttttttttttctttctttttattttttttttttttgttataaataatgaaaatgctgaaaaatgtacttcatttgatcattacaagaacaacataccacgtagtaaagtttagcgcgttttgattttctgatatctttagaaaagtagaggaaagaaaaaaaattcaagattataatagctgttccatgtttgttggtgcagaagtcaataccacaatccagcggcgatccccagcatcatcaccgtcgccggtctgagagatcatcaccagaacggtcagcacgagagcttgaccctttaccaccgcgcccgtctaaaagaaagtccgaccaccaccatgaacacagcgactgagatgctgatgattttgaataccacaagcgtgaccgcagtgaccgtgatcaccgccaccacccccgcaatcgctcagaatcctcttccaaagctgtctctgagacaaccactaagccagcttcaacaacagcaacagaccgcaatcataaagtaagtgtgttctctcgcattagctttccagcagaagaagaacccgccagtaagaagcgcaaggtttcttcctctagtgaagcagcaccagcgggtggtggtggcggccctgcatcttctgcacatcacaagtcatcatctccagttaataatggctactatgatgactataagtcatcttctgtgaaggctagaacgagcagtagcagtgctgctgcagctgccatggactacgagtccagtgatgatgacaggcactttaagaggaagccctctaggtgtgagccat

SEQ ID NO: 17531 - DNA, 926 bp, Populus trichocarpa
  Predicted polypeptide sequence is orthologous to G602
gggccaaatagagattttttcgagctagctgtatagttgaagagaagctgaagaggaagagatggcagagcaggaggtgaagaaggtagaggctgtaacgcccgtggctccagctccagtggaaactaaaagtgatgtggccgatgggaaagttacggctccaccacctccagtggctgcagagaaacagaaggcagctactgctgctgaggaatcaaaagctcttgctgttgttgaaaagacagaacctgctccgaagaaggtttcaggcggatcaattgacagagatgtagctcttgctgaccttgaaaaagaaaagagactttcctttatcaaggcatgggaagacagcgagaaaactaaagccgagaacaagtctcagaaaaatttctctgctgttgctgcctgggagaacagcaaaaaggcagctctggaagccaaactgagaaagatggaggaaaaactggagaagcaaaaggcagaatatgcagagaaaatgaaaaacaagattgctttaattcacaaagaagctgaggaaaagaaggcaattgttgaagccaaacgcggggaagaggtcttaaaggcaggggagacggctgcaaaataccgtgctactgggcaaaccccaaagaagctccttggttgcttctgaagtcgcaactttaggagcctagcatggaagcggaaagttgaatcatcattcttcctctgcatatagtgttttttaactccttgtttttcttgcttgcttgcttcttcttttttttcccacatggtttcatgtcttctttcattaaacatcggaaaatttaaatattcagtgtgtttatgtataggaatacaatatttgatctgtgagaaacaagtttaacatgtttgtgaagttggcttctcttggcatactagtgaggttgccttgtcgagca

SEQ ID NO: 17532 - DNA, 589 bp, Populus trichocarpa
  Predicted polypeptide sequence is orthologous to G605, G1944
tcgtctcgagaaaggtttttctcaggaaacaaacagttccttctctttcttttcttgttcttttgttctttagtgttttgctgagagaaaactcgaaagtgccggtactatttgaagaaactaagcgaatgtgaaagggaccgagagagagacgctacagtttctggagagtatcttcttaaagtctcgaagttgctgttaatctggaaaatagtattgttaggtgtagtgatttttgaataatttacagtttatgcatggagggaagagaaggattgagttcaggggtaacagtgataggagcagaagctccatcaacctatcatatggcgccaaggacagaaaatcctggccagattgtagtgtcaccaccagccgtagaggtgccaccagttggtgcaggattgatcggaggaactgcagaaaagaagaaaagagggaggccaaggaaatatggaccggatggggcggtcgctagggcattatcaccgatgccaatttctgcttcggccccgcatactggtggagactactctgctggaaagccggggaaagtgtggcctggtagttatgaaaaaaaaaaaaaaaa

SEQ ID NO: 17533 - DNA, 854 bp, Populus trichocarpa
  Predicted polypeptide sequence is orthologous to G611
ttttttttttttttttttggaaaagaatattgtcttcttaacatggcaattataaatggaaaacagcatatttcatcctatattgttgccttctacaggaaactgaaagatcagtttcaatctcaatatctataataatgtttgacctttgctagcctgtcttattgaaaaagtcaaattcacaggaagcacgcgcgtgcatatgtacaagtaaatgccaggcatagctcagtatatgcttatgttcattatgacaagtgactggtaaaatacaccctacaattacagaaacatgctccatgacatcaagccatgccaataatcagtcagtgagattggtgtttctttgctctaccttgggaaactgtggaatcatctcttttggaaccttcaggttttcgagcccatgcaggtgtctggtctggcccataacgataatcatagaatagctcctcgctagcttctatacgctcgtttgcaaagatgcctactcgatggtctcctactaccagcattacctttgcatagcaattaggatttgatgaatggttcgcaaatttcagcttatcccccttccggtaagcatcaaggacaaactgatcattcaagtcaaaaaggaatgatgaattggcacggtcgtaaatcttcccacgcttatctgcttctcgatgagagatcaattcaccagtatattctccaagataatcatttttgttgacgggtttctttaaaaaggctccccatccagcaacatcagattttgccaagaggatcctctgctgctgccttagaagaagcctcatgtttccacattggccatctcctcgtttcggaggctctcctaatgaaccatc

SEQ ID NO: 17534 - DNA, 787 bp, Populus trichocarpa
  Predicted polypeptide sequence is orthologous to G616
ttttttttttttttttttaatttcaatcgtttgttatatttcttcaaaacacacaaagctttgcacgcatagattcgcgcatacatatatatatggatgcaatctgaacgacttaaaaaggggtaaagcggaaataccaaaaatttcagaagcatgataataaggtatcatccaatgcaaggaaggaacgtatttgttcatggtttgctgccatttcccatcttcattctcctgtaccaaattaacctctgatatcaacgtgcatgccattcactgaaagaagatgccacaagaaaaacagacgcccacaggcattaatcagttcttccctttgcctttctggtcagaatgcctggttccatcgccatagcagagctgcaacccaggtgggaactggtggtggttctccatagcttgcggtgctgcagcaccgataaagaaaggtacatttgtggtagatccgtctatggtagaagacgtagaaaacctctggaggtgaggcaaaagagacggtgatgatgaattggactgaagggtccccctatggtaacctgcggcaaggcctgaagatattgtgaaatttaggttataatccccgctggatgccggcggttgtgttgtggcggccactgggatcaaatgatctgaaacgaaaggaaaatgttgcaaatgctcctggtgattctcccccgatacacaaaatggtgggatcgacattgtcattgcttgtgggattgagttccctaactggatttgccctggaaaccccgatgaatgatgagttgac

SEQ ID NO: 17535 - DNA, 825 bp, Populus trichocarpa
  Predicted polypeptide sequence is orthologous to G622
ttttttttttttttttttgcgtgaatggaaaattaaacatacagcaaaattgcattttctatgactgtagagatatgtatagcaccacccctttggaggggacattaaaaaaaaaaaacgaaaataaattacactattcgagtgaagaaaatcgaactcctcgtgaactaccatatcaagccgatataaatcgaatagacagcaccgtcaatcgcgtctgctctcatgagcccatcctattgatgcaagaaatgcttcatcggacaggcgccttagactctctccactatgttgagcttgacctccctcttggtcccacaccaagcttgaaagaccgttttgcttgatataattatccaacggtgtgttggccaagtcaacaaggttcatcgtgctcaatcctggcatgtccagcggcatgtcctccctgttaggatgacaatttaggtctatttgtccagcactagtttctggcttctcagtttgcgttttgctttgaccgacttcagtctccggattgtttataggcaacacttcatgactcattgtgccattcgcttctgattccttacgatccatgttgtccttctgagaagtttctgcttcgcgttctgattggcgcttcttcttgcgcagcatgagggttttaaaacggcgctttacagtcatgcagacattacatgtgcatgtgggcttgtgcttgcctttcccacttggtggttgaatgcaaacgatgcaagtgcaaccagggcggtgacggggatgctttgtggtggctccaactgatggctcacctgaatcatctagattgtctcctaaaactgc

SEQ ID NO: 17536 - DNA, 717 bp, Populus trichocarpa
  Predicted polypeptide sequence is orthologous to G630
ttttttttttttttttttgggatataccttatttgaggttaggttttttttttttttgttaaaaaaaattaatttcattttttaacatttgatttattgagaattagtcttcgtttttttttttcaatcttttttccacgagattatctcaatttcatgtctatgattgtgaggttaatgagttaattcgggttggctactctctttttccatagcttttttttttaattaattttttttctagtttcgcactttagtattggattgtttgataactgagcttcatagttttatttagtttgtttttgacaggattaccccgatatcataaccaaatcacagatttgatacgctaacccgagtgagactgagtcatttttctgggtctttttacattgccaatatttttaatttatttattgttttaatattttttgttcatattatttaaaaacatattcaagttaatgacctgccttacttagtgtgtttggtattgtggtaacttttgtgattgtggtttgaaaaaaaaattgttttatgaaaagtaattttggttaaggttggtttggtatttatgtatgtttggttaaaactgtggttgaaattgagattaaacaaaaagtagtttaatgtgtttggttaagaatacttttgaaattgaggttataaaataattaatatatatatatatatatattaatattggatggtttt

SEQ ID NO: 17537 - DNA, 828 bp, Populus trichocarpa
  Predicted polypeptide sequence is orthologous to G646
ttttttttttttttttttaatccttccatgtaaccctatctgttagctagctagctagtttctatttaacataaaacaagtcactcgatcgccaagtgaagtgaagggaaaggaaaactaaattaagataaaacacaaggctaaattaacatcttgtgatcatatccataattctctatgtgaattttaccatgattcaccacctaacattccattccaatagccaggagcaccatctccttgccctctagcattaatgcgctcaaattcagaattacttggaacctgctgcttcaagtcctcgataggaaacaaaagccttgcactactaccagtctcatgcacagcttgaatgtttctatacccactttcaaacccttctaaagaaaagttctgggttgatggcttgaattcttgcaaaggaaacccagttgaaaacatgttgtttgaatcagacgctgcgggaattgacatgaaagcgctaaatccccttggattcattccagaactcttgagaagctccatagctgagatacgagatggagggtaagctaggtttagatctgggccttgatggatcttagggttttgatcagtagctgactgatggaaatttggctgggtcagatcaagaggaaacttcttttcagatgctgccgcagctgatgatgatggattacttgatgatctcttgttctttctcgaaccaccaccaacaggaacatttcttaaagacccaccttcagtccagtaccttctacaagtcttgcaaaagtatcttggctgagacagactatagttgttgtagtaacaaaattttgtattggt

SEQ ID NO: 17538 - DNA, 862 bp, Populus trichocarpa
  Predicted polypeptide sequence is orthologous to G653
tttttggtagaatccaatatttgcaattgaaattcctccgcaagtaattttacatttgtgagaatttgaaacccatctatcaatcaaacacaacaaacatgcccagtatagctgggcagaaagagagaaaaaaaacaaggcagaaccaagttttgcctactccttccaatggaaatcggagggcatggaaggaaaacacaatgaaaagtagataaagccacacaaataaaatatcaaatggagatatttaagcctctggcacagaagccgctgcacgcttcattgttgcggacttgatgaggtggttgtagctgcccttttccttgaaaagttgggagaagtgatgcttgcaatacaatacgccctcaagtgctgcataatttgatggtgttatagcacagccaccgtgcgagcacttgaaacatgatttgtgataggcttggctttcaactgttaccttctcgagcggataagcagttttaccgcaagtagcgcacttttcttgtgtccctgaaaacatgctagcagctttgctaggtgaccttgtcagttcaggatttaacttctcagctgactttgcaggtgactgaaagttcttgttgaagttaccggtctccttgaacagctgctcaaagtgaggcttacagtacaatacaccctccatcgaagaataattgcttagctttaacgtgcctttgcagtgaaaacacttgaagcaagttttatggtaagcaaccccatctgctgatagaagttccataggatacacagtcttctcacaagccttgcatttctgttgggtaccagtaaacgacatcgtttctagctatataaactataccctctagatctgatgactgtc

SEQ ID NO: 17539 - DNA, 556 bp, Populus trichocarpa
  Predicted polypeptide sequence is orthologous to G653
gcttcgagcagtcttttgaattctatctggaatttttatcttgaatttgtacattttcctttgcgaacagctttaaaaatgcctttcgtcgcagccgaaaatccaaaatgcccaacatgcggcaaatcagtctatgcagctgaagaacgtgttgctggtggatacaaataccacaaaggatgcttcaaatgcggtatgtgcaacaaaatgttggactcaacaaactgcacagaacacgacaaagaattgttctgcaagaattgtcatggccgtaaattcggaccaaaaggatacggttttggtggcggtgccggagccttgaacatggatgatggtacccatcttaatcaccatttcgaacattttaaataagtggttaaatgacatgcacgacatctcccttgttctttgtccgttcaacagataaattacacacacgcacacacacacacaaacacacacaatcaagtaaaatccatccgcagaacgtgcataaaggaccttcaaaaacaaataccaaaatagaacaaaaatatataaaaaaaaaaaaaaaaaa

SEQ ID NO: 17540 - DNA, 890 bp, Populus trichocarpa
  Predicted polypeptide sequence is orthologous to G653
ttttttttttttttttttagcacctatagcatccaatatttgcaattgaaattcctccagtccttttacaattttgggagtttgaaacccatctatcaatcaaacacgacaaacatcctcgctgagagctgaagggagaagttcaaaaataaaaaaaggcagaaccaagttttgcctaccccttccaatggaaatcgaagggtttggaaggaaaacacactgaacagtagataaagccacacgagtagatatcaaattaaggaagagatgtttaagcctccggcacaggagcagctgctcgcttcattgatgcgcacttgatcagatggttgtagctgcccttttccttgaaaagttgggaaaagtgatgtttgcaatataatacaccctcaagcgctgcatagtttgatggtgttatagcacagccaccgtgagagcacttgaaacatgacttgtgataggcttggctctccactgttaccttctcaagcggataagcagttttaccgcaagtagcacacttctcttgtgtccctgaaaacataccagcagctttgctaggtgaccttgtcagttcaggagttaacttctcagctgactttgcaggcgactgaaagttcttgttgaagttaccggtctccttaaacagctggtcaaagtgaggcttacagtacaatacaccctccattgatgaataattgcttagctttaacgtgcctttgcagtgaaaacacttgaagcaagatttatggtaagcaaccccatctgttgatagaagttccatgggatacacagtcttctcacaagccttgcatttctgttgggtaccagtaaacgacatcgtttcgagcgatatgtattataccctttagatctgatgactgtgtact

SEQ ID NO: 17541 - DNA, 330 bp, Populus trichocarpa
  Predicted polypeptide sequence is orthologous to G663
ttttttttttttttttttgaacccttgaattgatcgaagcttacttttatttatgaaagttgtttaaatattattggaaggagccaacaagaaagtggctctaagaaattacacagttacaaagctcaaatccaagccaaaaggtcatgctttctgcgcgatatatgtacatatatataaactacattatgttttgttacacaggtggtcattgattgctggtagacttccaggaagaacagcaaatgatttaaagaattattggaacacaaacctgagtaagaaggtggtttctggcaccagagaagctcaaacaaaaccagaaccaac

SEQ ID NO: 17542 - DNA, 378 bp, Populus trichocarpa
  Predicted polypeptide sequence is orthologous to G707
ttttttttttttttttttgactttaggagaattgagacaagggagagtcatgtcataagaaaaaagaagagttttgaacttgagacccctcgaaccctaaaaacggaaataactttagaatcgcttgttgttactgttttcaatttttgcagtccgtacggaaatactcgtctctatcttgacggtagaacacttctggattacaggaaatatcagtaagagactttcgagctttccttgggagaaaatgtatcaacgctatcgcatacatacatagacaatcacaataatcaagactttcgagcagagaagaaacaatatatcttgaagattattaatgtcagggagtggaatcggcaaagctaagctatttaaacc

SEQ ID NO: 17543 - DNA, 819 bp, Populus trichocarpa
  Predicted polypeptide sequence is orthologous to G715, G1646
ttttttttttttttttcaattcaaatggtagcatatgacgcaatagaaccattcgaatcagtaacaaatagatcataaattaataaactgcacatcagataaagttagcaagttatagcagcaattgtagagctgccatacactgaagttaaaaatcttaagaagtctctacagctacggacaactttccagaaaacaatagcaagcaagcacatttagatatcatatgcactcaaatttcccagtaatattagccaaggcccttgttagcctctgtcgcacctctgcatccgagaagcttaatcttgtccatcaagattcccttgtccaccactcgcaccaccactcccataagaaccatcttcggtggcagctgtctgccaaacagactgccaagcctgagaaggtggttgaacatacaccccagtggcaggatccatggctggccttccgatcatcatccctccagtggcagcggcaggctgtcccatcggagggtaataatatggcaccccactagccgtagcaccgacaattccaccaagaccagcagcttcctctttgatctcatctctaggtacaatatcaaccaagaaatcaaaaatgtcagttcttgtaatagcagcagcaatgtcattcttctgtaaagtccttctcttgttttcctcagcgtgaagccaagaacgaattgtcagttctaaaatgaaaagctcacatgctttagcaaagagaataggtgcttcagcagagatcatgcgcacatcctcgtcagctttcatgattttcttgattcttgctaaagggagttgatggttcttg

SEQ ID NO: 17544 - DNA, 975 bp, Populus trichocarpa
  Predicted polypeptide sequence is orthologous to G715, G1646
tcgagccctcgaaaacaaaacaaaacaaaactacttttgtctccgatcaacaaaacaatggacaacaccaacaccaacaccaatcaccagcctcaatccaccgcatacccgccacactccaccaccaccactccaccaccaccaccaccaggggcaccatcctcagccccattccaccacctccttcaacaacaacagcagcaacttcaaatgttttggtcttaccagcgtcaggaaattgaacaagttaatgatttcaagaaccatcaactccctctagcaagaatcaagaaaatcatgaaagctgatgaagatgtgcgcatgatctctgctgaagcacctattttgtttgctaaagcatgtgagcttttcattttagaactgacaattcgttcttggcttcatgctgaggaaaacaagagaaggactttacagaagaatgacattgctgctgctattaccagaactgacatttttgatttcttggttgatattgtacctagagatgagatcaaagaggaagctgctggtcttggtggaattgtcggcgctacggctagtggggtaccttattattaccctccgatgggacagcctgccgctgccgctgccgctggagggatgatgattggaaggccagctgtggatcctgccactggggtttatgttcagccaccttctcaggcatggcaatctgtttggcagacagctgccgccgaggatggttcttatgggagtggtggtgccagtggtggacaaggttaagcttctcagatgcagtgattagtggcatgacagaaggcaaatatgtaccttgactaatattacttggaatttgaatgcatatgatctccaagtctacttgttggctattgttcaagaaagctctccttagctgttagagacttcttaaaacttattaacttcattgtatggcagctctacatttgctgctgacttgcctaattatatctg

SEQ ID NO: 17545 - DNA, 905 bp, Populus trichocarpa
  Predicted polypeptide sequence is orthologous to G718
gatcttcacatcactctcactcactccctgcttctctcatcaatcataaacagcaaatcagcattaatagtagttaagttctcttctcacttctcaggcagctttttatcggagatcccttcttctgtttctttctcatctgaagttttaggtttgcctggtattttgtctgagttctctgagctggggagttcagggctttcggaggcatcaagaggaattactttgtaagattgggaaacaagcagatcggattttgttctcttaaagcgaataaagattagctctgataattcagaaaaacagaggtggctggcacttagaatcatcaagatttgaaggatctggtgtcccattgcttgttgatttcatgaagaagtattctttgtgaagtgattctataagttctgactcactgatggagtggaatggcaaaccccacttacagtgggactgggagagcctgataatgttcaatggaataacaactgaaaattctaagcagttaagcccaacagatttggaaactgatggagaaaaaggaaccgactctgggtttttctattcatctgggagtgcaagcagaagcggtggttctagctctgatttggaacttgcttctttctcaaagtgctcgaagtcagcttccatcaattcttcatcagctggggaagttaaaacatccaaattcactttggaggcctctaaagcaaatccatctgattacaataagaaagaaattggaaaggctaagacagctagtatgtcttccacaattgaggctgcaggtggttcaggtgaccagctgcttggtttgaagcttggtaaacgaatatactttgaagatgcttgtgctggcaacaatgttcagtcgtcatcattttctacagttcctgtgccctctt

SEQ ID NO: 17546 - DNA, 928 bp, Populus trichocarpa
  Predicted polypeptide sequence is orthologous to G720
ttttttttttttttttttctatgtcaagttctcaactttattgaaaagtccatggagcacagagcaatatctctatcaccctcatttcccattattacagcaccacaaggaccccatcagctactcctggatcaaagctctcaggctttttatctacaaaaaaacagaacacccggaagggcaacgcgccctttcttaggatgatccattcacaaccacaaatttgacatgaggtgcatggtggatctacatggctctttcatagccgtttaagctgcctctacggacatgactgcttactgtgccattgacgggatcggtgagacctttctgactatgtggcctgatgtcagctcctgcgcatgcacttcaaagacacgtgacttgtctgttgaagattgatggtctcaagccacttgagaatttgctgtgtacgtgtcaaattatataggtcgaaaaatttgttatgattggtagagtctatcttcgattgatgaaggaccaggagaactggaatcggctttagcataatctgatgaaatggcaccacccacattagaaggaattagagccattaatgcggggaggaattgatgagacgccttgcctggagagctctgctaggacgctatcggcagacgggggcttgaggcccaagggcaaaggtagccatggcttgttgattgcctctttcactaccttgtcgataacctcctcggccggctgtaggtcaaacagtttttgtggcataccacagctgttattgaccatgctggcactctgaaacccagatgcataatgaggaatggtagaataaggattatgtggtggcatcacagggcaaccccacgcatctgcatgcatccctggataaggcttccaatgacaactttctgtcgggggccatggggagtagccgggggggccc

SEQ ID NO: 17547 - DNA, 642 bp, Populus trichocarpa
  Predicted polypeptide sequence is orthologous to G728
ttttttttttttttttttaaatgaaagctgtaagttttaaaaaaaatttacgaaacttcttagaattcgtaaatatgaattacagaaattcatgatgaactcaacaggaagggacatagcctatattatctgccaaatttcaccatgcctctaatgttactgtctcaaggtaaaaaaacactccaattttgaatcctatctttgtaaacttcattattctgctcatctctacagactacaacccaattccctatgtatatttgtatctgcaaatttcatgggatcagaatcggtttgtcacactatacatgagcttctcctggtttgtgaagcgcaccattccaactatgactctctgatttgtcatcgtcttctgcttccatgctatctcctccagtattagaggtagccttggcagagccacttgcatggagggatcctttcggagaattagactgtgaaatgttacctgttgaagggtccttgcattgatcttgagatgctggggctgctggggatgctgggactttacggagatgaagcctgtatttttgcaagtggcttttaacttcatcattggtgaggccatccacttgcatatgctctctgatctgtttaagagtggccacttgacaaccacca

SEQ ID NO: 17548 - DNA, 863 bp, Populus trichocarpa
  Predicted polypeptide sequence is orthologous to G729, G730, G1040
ttttttttttttttttttcttccttttcttttctttttctttagctctgattttctcacctgggtacctgattctcttcaccagcatcccctcagagataataatgattcaaaatgagtagtacacagtggataacttcaatgtggcctgcccaaagtgaactccaaattaggcttcttggggcttgtccctgaaacggtcgatgagcttacatctgatattttctcatagctcaagcactttggatccatgcccttctgctcaagtggtggtaagtttccgccagaatcctttaatttcccatgcaaccaagcttccctgcttgaagagttgctccagagagcctgatagtccttgtcctggtgagcatttggtcttccctgttgcattgacatttctgaccttctaggattttcaatgtcaaataccaaatcttctgaagtatctccagatgatccattatcgaacacgtccgatagcgccgaaggagctgctgctctatcagtggtcttcacagttcgatacatctgcaaatgtgatttaacatgtgccaaggtgagatctttcacatccataagctcaagaactgacttgggtgtagcccctaaaccccaacaaagaaaagagaagaacaaggaaagaggaaaggaaaatatgagtcaaattttcttttccaagttccttttttttgttttttcagtgttattgaagatggtaaaaaaaaatgaacaggaaaggtgaaagaagaagggaaaacttcggaaacgataaaaatgagaatctagaaaagaagaaagccagaggagaaaaaagaaacaaaatgaagcatactttcatggccacccaatagctcaacagcgtga

SEQ ID NO: 17549 - DNA, 772 bp, Populus trichocarpa
  Predicted polypeptide sequence is orthologous to G729, G730, G1040
ttttttttttttttttttattattattattatttgtccttttattctccactaaagcatgcattctgtaactaacccatggcatcaaagggtagacaagagattaataagcatggtacagcagtggtaccttgaagagttgctccagagagcctgatagtccttgtcctggtgagcatttggtcttccctgttgcattgacatttctgaccttctaggattttcaatgtcaaataccaaatcttctgaagtatctccagatgatccattatcgaacacgtccgatagcgccgaaggagctgctgctctatcagtggtcttcacagttcgatacatctgcaaatgtgatttaacatgtgccaaggtgagatctttcacatccataagctcaagaactgacttgggtgtagccctttcatggccacccaatagctcaacagcgtgaacaaagcgagcatgaagagtggtagtccaacgcatccttggtgctctcatacttcttttagctggaaacctagacatgaatcttgatctcatcgacccttgagactgatagggacttatacttgtggcactagagctattagcagccagagaagaagcctgggagcaagtattatcaaaagtttgttgagagaatggaaaaagagaaggagggttttggtagacaggaatccctctaatgggtctcaagaaaccaagctcttggctcagtccttgttgttgttgctgttgaaagagcactggatgatgattatgcaggtggttttgtt

SEQ ID NO: 17550 - DNA, 662 bp, Populus trichocarpa
  Predicted polypeptide sequence is orthologous to G732
gatctctcaattctgcctggattatattatatagtaattagtaagaatatctatatacaatatttatcttaactctggatattattatcgctacctgggtcctgtgtctttgaaatctataaggttggaattctccgtactataaagatctcatttttatcgaggtttattgctggtggtagtgtttttggtgcaaaatatatagtctttctgtatctatatggcatcctctagtgggaattcctcaggttccactcagctgcaaaactcgggctctgaagagcaggtggtgttggtggatcaaaggaaaaggaagagaatgctgtcaaatagagaatctgcaaggagatccaggatgagaaaacagaagtacttgggtgatctaatggctcaagtggcacagctaaggacggacaataaccaaatccttacaaccatcaatgtcacaacacagcacttcttgaacgttgaggccgagaattctatcttaagggcacaaatgatggaactgaaccatagacttgattctctcaatgagatcctcaattatatcaacacaagcaatgggatttttgaaattgatcatcatgaggatctccaaactagtgcagatcatggcttcatgaatccattaaatttgatctatcttaaccaacccatca

SEQ ID NO: 17551 - DNA, 883 bp, Populus trichocarpa
  Predicted polypeptide sequence is orthologous to G732
ttttttttttttttttttagaaataataccattacatttactataatagcgaaatcctactacatcaaactgtaaaactcgcaagcccatttacagaccaagaaacaaactagccacaacccttttgttctttcttacatatccatctactccccaccccgtgacttctacatatgttgccttatttcaaactacttaaattataatcagctcttgagtgataatttcttaagcttgattattactaaacagatctctctatctctcttctgctcgagaacagatcagtaatgaaacatctctgcagacgccattataggctgattcaggtaggccatgttccatgggttcaagaagctgtcagctgctggttcatttaaggtgctcgagtctccaaaaacaccattgtttgaattcaaggaaccgattatctcattcaaagactccaatctattgctgagctcgcttatttgaactcttaggattgagttatcagcctcaacactcaagtaacgctgagttgtgatattgatgcctgtaataatctggtgattctccttcctcaattgagacacttgagccattagatcatccaaatgcttctgttttctcattctagacctcctcgccgattcgcgatttgatatcattctctttctcttcctctgatccatcaatgcctgcaaatcctcctccgaacctgagttttgaatcaaagatgatcccgaagatgttccactagaggaagccatgagagacccacaaaacaggtttgcaacttttaaacaagaacggcaacaaatagagagttatggcaagacccaaatagcaacaaactcaaaagtgaagcagataatagtagtagtaatagcaacaaactcaa

SEQ ID NO: 17552 - DNA, 895 bp, Populus trichocarpa
  Predicted polypeptide sequence is orthologous to G735
ttttttttttttttttttggtaagctgttctatagagctagattttgcattgccaattgcggtaaaaaataattgtttgattcaacatgtacttcaagaataggatctttacatacagttaaaccaaaaatcaaactggaatggaatcttcttctctaaatcttcttgacactcggggttattttgcttgttacgactgctccccattggactgaggtccacaaggacttgcaaccccacgaatccgtttctgcaaacgctccaagctagccactcgctgcaaagaagctgttcgccccaacttgttccctgatactcctgccgctgttccagaatttggctgcacattttcaactgaagatatatcggccaacacaaagttgactctgggcctggagtcatgagttgatataggattgttaggagcctgatagaagtgatgctttggatcatccttgacagggacagcagcatctgctgatgtgtcagaggggcatccatcaaacgatggcatactcattgcggatatatcaggcatggcatggaacatatggttcaacccagtaaatcttttgaccgtctcttcagccatcctcacctttgctctcagcgtttcaatgtcagcttttaaaactctgttgtcaacagcagactcattgtacttctgacttgtttcggcgagccgcttcagcagagaagagttttcaaccctcaattgagcaacctgggtctcaagctcagtcaaatgggcctgctttcttcttcttgatcgtctagctgactctctattcgaaagcattctccttacacgttttgcatcagcaaggtgcatattctcagttatttcagtttctgcttcattttcatcatcttccgacagttctctggatgatcc

SEQ ID NO: 17553 - DNA, 756 bp, Populus trichocarpa
  misc_feature (687)..(687): n is a, c, g, or t
  Predicted polypeptide sequence is orthologous to G736, G2432
ggtcccaacatgttttttagcactttatatatgcacataagcaccccccattcctatctttctacaagtaaatcttctctctcattttccccttggtaacccgcaaattagtgttgatatttctctctatctcatccttaatttgtttatctccatcatggctagccaagaagagggcatcaagctctttggagcaacaattacgttgcatgataaacaagaaggtaataaagaagatccaaacaaggaaaatccaaccactgacaagagaccagagaaggtcataccttgccctagatgtaagagcatggagaccaagttttgttacttcaacaactacaatgttaaccagccaagatatttctgtaagggctgccagaggtactggacggcaggtggggccctacgaaatgttcctgtgggtgccggccgccgggaaactaagccacctggccgggttggtcttgacggttactcggaggggtgcttgtatgatggctctggtggggttcaccgatttgagctagatgggatggttttggaggagtggcacttggcaacgacccatggcagttcccgtcatgttttccccgtgaagcggcggaggagcggtggctcaggtggtcacacttgttgatagtctttatctttaccatcatgcgtgtattatatatacaaaaccggttntgatcatataaccttctaaatttctaatggtagttctatgtatgtgcatattaacctcataacttgata

SEQ ID NO: 17554 - DNA, 758 bp, Populus trichocarpa
  Predicted polypeptide sequence is orthologous to G748, G1900
ttttttttttttttttttagtactaaatgagatttacaagtttattctacaaagagaaggattttgttacaaccaagaatctctcttctgtcaagttatctcacacacttacataaatatataaacatctaagataccatgtacatgaaaaacttaggaaacagatatcatctaagatggataaggaaaaactactggtcttaaagtggcagggaagtacatggtcctgtcagaggtggctatgctattcttgagagtcaaaatagggacacgctattctgggttcttttctctgtaggaattctgtcaataaggtggccttctggtgatgtaagtgtcaaccttctagtgtaaaagggaacacaaattcgttgagatttagaagctacagcactctgatgaaaaactccatttcattgcattactgttatagtagaaagtgtacaacttagctgatctctcatcaagtgttctcatggaaattgagagaccgggaaaacgcagcagggttcgcttgcaacactgaagttgttcctgccatgtaatttctgtcttcgctttttgactgaaagcccttgaagagacctcctccattaattgaactggatttctcattcgtgatcccgagggtcgcccatatagagctctttgcagcttcactaggatcatcaatcctcaaggtctttggaaccaaaacacccgtttctgatttggtgccgtccctggagggctcttctaagcagggtggattaaggatg

SEQ ID NO: 17555 - DNA, 599 bp, Populus trichocarpa
  Predicted polypeptide sequence is orthologous to G748
ttttttttttttttttttgaacaattgcaaaatagtacaactctagaagagatttactattccagctgacatggttgagatatagcaaacgagaacacaaattacagcatttgagaaaagatactggacttcagaaaactttggttagccttccaatggatgatggctttaatttatacatacaggccagagcttcatcttatttttctgcagattccaagcagtaagataggtatgagtgtattagttgaacctaaaataggccgcggaccataaccaccacgcattaaacaacctctgttatttacaatgacgacttgaagagatgtgttgacagcaccgccgattatgtagcaattgattctgaagaacttgcctttcagacttcaatcagaattagttgagcagaaatctcatgcgctgtgaaggaaaatcaatgtggtatactctccacaaaaaacatgtccccgtggttatgcctagagaagatcacggacgcaagtgaggttcacaatggaaaatctcagcaggtgtcctttagccactctcctggaatgtatgagagcgagaaagagctgctgggtttgcttccagtacat

SEQ ID NO: 17556 - DNA, 835 bp, Populus trichocarpa
  Predicted polypeptide sequence is orthologous to G760
ttttttttttttttttttatttttttttttttttttttttttttttttttttttttttttaaaacagtaagtaggcattgtgagcaatttcatatgattacagtgaaatgaagtcaagcatgaataacaatcataaagtaatggtttatcttgatgtcaagctgtcctaataaatctatatggaattaactaccaacaaatccctaaaatactcaaccaaaaaacaggatttgggcacctcttagccaactccattcaccttaggtttacttggcacaaatacaggtcccaattttataacttacagagagaattaggacccaaaaaaacatcaagaaaagccaaccccgtgacaccacaaactctgccttgcctgaaaataagctagtcatcggcacccaactggcaggaccaccttcttgttgtggcaaaccaaaagaaaggatgacatcaacattcccattcttgccaaatgaccactccgtcccattgccacctaagctcatgttttctattcttatcacaccagcagtaacatgaattgagctggaagatgctgactgtaagcgaaaaacaacatccttggaagggaactcggaagcaagtgcagggggtgcaggaattttccccaacatgtgactggcctgcttgatgaatggatatttgaaatcagaatcaaattccatagcctctggcttttgctttgatgaggatggaccaacattgccatgtgtttctaatggtttttggattgcattcaacacttcatcagttccacccttgacatcctcttggggaggaggttgttgattggaaacagcagtatcacttgcaa

SEQ ID NO: 17557 - DNA, 746 bp, Populus trichocarpa
  Predicted polypeptide sequence is orthologous to G772, G776
ttttttttttttttttttttcttttttttttttttttttttttttttttttttttttttttttttttttccaacaacaaaaaaggaatttctttttacccccggcaaaagaacaaaaaaacaaaaccccccactttacttctcttacaacaaaaaactaaacggaaaaacaacaaaaaaacccaaattttacatatggcattttacccaacaaaaagggaaaaggagggggccggggcggggtttttgatttttattacaaacaaacggggggattacccgggccccgggcacaaacaatttcccctggttgggaaaacggattcgggatggacgggatttcattggggggggaccccccttttcaaaccccctttttcctgggggaaaaagccaacccgagaggggaaaaggttaatcggggggggggcccccatcttttcaagtttcaaggtccctcccccaaaaaaaatctggggaatcccccccggcaaatcattgaaaaacttccggcagctagaaaactttgataaaccaagactagcaccttctaggggggggggggaaacacaaggattttcttggggttccaaaggtcccaccagcaaaaattctagcaacccaaaattggccgttgttgttgctaaagtggtggccaccaccattccggcgaaggttgtggcggcggttgttgttgggaaaaaaaaaggatccggacttgtccttgtggagttccccaaaccattt

SEQ ID NO: 17558 - DNA, 847 bp, Populus trichocarpa
  Predicted polypeptide sequence is orthologous to G772, G776
gaaaccttatctccactcccaaaaaaaccctagcctccttttccaccatttcccctttcccaaacaaccatagcccatcatgggtcctgaaacttcctcgcaagaacagcaattacgactagcactgacaaccccagcaccaccagcttcagcaccggcaaaaacgacaccagtcagtactaaaacgacagcgttagctcctgggtttcgattccacccaacagatgaagaactcgttatctattacttgaaacggaaggtttccaataaacctttccgtttcaatgctatttctgaggtcgatatttacaaaaacgaaccttgggaccttgcagataagtcaaggttgaaaagcagagaccaagaatggtactttttcagtccactggacaagaaatatgggaatggagcaagaatgaatagggcgacaggcaaaggatactggaaagctactggaaaggaccgggaaattcggcgagagtgtcaactccttgcaatgaagaaaactcttgtgtttcatagtgggcgtgcaccaggtgggctgcgcaccaactgggttatgcacgagtaccggcttattgatgaagaattggaaagaaccggagctatgcagatcgactcatatgtcctctgtagagtgttccacaagaacaatataggaccaccaactgggaaccgctatgcccctttcatcgaggaggagtgggatgatcgtggagcagctctcattccaggagaagatgctgctgatgaggtggtggttacttatgatactggtggtgaaatgcaccgtaccgagcaggatagtcattcccatcataaaagtcctcttggtattaccgaagtt

SEQ ID NO: 17559 - DNA, 923 bp, Populus trichocarpa
  Predicted polypeptide sequence is orthologous to G773, G1412
ttttttttttttttttcgaaaattcagagacctatataatttccataacagttatggtttttccttatacagcaatgttgttcaagctaaattatactgataagcaaatgcttgtgtacatggaatctaatcctctaaccagcaacccaaaaagcaaggctattttcacttgccttgttaataaaagcggcctccatcttctctcttttggaatctgaatcccaagaggtacccccaaagaatccaatatttacagaaatgcactcctaattctgcctaacatttctcactgcctaaacccatacccacttcccggttgggtcgaataccttagctcatatgggtcgagtaaggtagaagagaagttcggtgtcatcacgcccgagttttgttgaaaagcccccgagttgccatctcgcagctgagttctaaccccactttggacctcctcttcaaccgaggtccccatcctccctgttgatgaatccgcgtggcagagtgggggcattgaagggacatgcacaccattgacattggtattcgagtaattcgcaccaggctgagtttgtaggagttcaggcaacgagttgagcccagcaagtgtcgcccagtcaaagctccctgaacccagatttgctaagttgattttctcttcgttgcatttgtttgagtgagttggttcgaggcaaagcaaagagccggtcatcaatctctgtcaatgagtcaaggacatcttccaaatgagaagaggatgatgaacatgaaccattagtactgtattctttgcttgaaacgcttgacatggatttctgtgcagcacttgaattcttcttgtaaatccgacacaatacccattcatccaactttgtacttccacttttgcgagaggattcaagaaggcgatattcatgcatgatccaatt

SEQ ID NO: 17560 - DNA, 861 bp, Populus trichocarpa
  Predicted polypeptide sequence is orthologous to G783
gcttgtctttcagccaacgttgtttcaatcaaagatttggaagcctgtcttttacttttttctttctgggattttttcggctctgattttaagattttgttgactgagatgagcacgggctcagagcctgatgtaacagtggaggaggtgactggaaatcggagctttcctgctgggaagaataaggggaaagtcccgagaagaattcataaagctgagagggagaagctgaagcgtgagcaattgaatgagctctttcttgacttggcctctgctcttgagttgagtgagccaaatactggaaaggcttctatactgtgtgaaacgactcggctattaaaggacttgcttacacagattgagtccctcaaaaaggataatgtagctctcttatctgaatctcgctatgtaactgttgagaaaaatgagctgagggaggagaattctgtcctagaaaatcaaattgggaaactgcagggtgaactggaatcgagagtggctgcgcaatcaacacctgtcctaaacgtgccgcctccagaatttcagcaaccgccacattttccaggagactcgttcagattgcctgctgtggatgctgctgctgctgcattgcagcagacgccagctgtctttgtggttcctatccgtcctgatcatgtgcaaggtcttccaatggccacctcgaatgtgaggaaaccacatgctagatatccaaccgctgctgattcttggccgtctcaacttcttggagagcagcaaattgctaggaaggaagttcagtttagtggcaaggatagcgctatctgtaatcctggggaacgatgccatccttaaccttaaaaaacatgctaaagtgtagta

SEQ ID NO: 17561 - DNA, 939 bp, Populus trichocarpa
  Predicted polypeptide sequence is orthologous to G789, G1494
ggttaaaaacagaccctcctctatctctctctctcgggctagtccattctcaaatttctctttacacagctttctacagagagagagagagagagaggtcatagtggaagttgaattggttcagttgaattggtttggtcagtccagaagaatgtctttttttgccccttttatcttcttctctttcgactttccttttcttgacacaactatttgtgggtcttcgagtttctgtagtccttcttcaaaagactgcacctttgttttcttgaggattctccaatgggtcttgttttcaaaagtttccctctttgactggtgccgattttgtcttcttctttttcaagcagggtgcttcgtgttgctgattctttctttcagtctgtctttatgatatgcatacagttcttgatactatttaattccatttcatgtttatttattattaatttacctgttggtgtgttacatggtttctcctcgtgtttttttttcttttttctttgaccattttataagacttagataatgacacagagcatcatacccgttagactgataataattattaatactttttgtcaaatattttaaacttatcttctgtgttgtgtttaacaggatatctgtgtcttctcagccatgaatcattgcattcctgattggaatcttgagggtgatcttcctgtctccaatcagaagaaccccatagagccagacaatgagctagtagagctgctatggcgaaatgggcaggtggttatgcacagccaaacacaaagaaaaccaaatcctcacgttcaaaaacatgattcaccaacagtaaggggctatgactcaactctgaattcaagtcatttgattcaagatgatgagacagtttcttggattcatgaccctcttgaagattcctttgaaaaggagttctgttccattttt

SEQ ID NO: 17562 - DNA, 467 bp, Populus trichocarpa
  Predicted polypeptide sequence is orthologous to G791
gagcggcaagtgaaagccttgagtactccaccaaacttcctgcctcatccctctgccattcaagctccattttctgccccaggccaagttgttggcagcaagctgatgccctttgttggttatcctggaatttctatgtggcagttcatgccccctgctgttgttgatacctctcaggatcatgttcttcgccctccagttgcctaagtaattcaggcagggattttatgtctatgttctctcagaacatgaaagcttttgttgcctttactaactatgattcttgttaatggtcacagataatgtttgtctttcaatcatctttcgctctcatagattagttagtataagagtgtatgagtgcaatcacagatgggaaactcggaattcctagcgatcgctggaatatcttgtaattttcattaatcaaatttggtaattttgcttaaaaaaaaaaaaaaaaaaaa

SEQ ID NO: 17563 - DNA, 825 bp, Populus trichocarpa
  Predicted polypeptide sequence is orthologous to G791
gaataattcatttgagaattcagatggtcttaaggaaattgggtttcgaaaacgggtgaggcatggatcaggtaatgcacctggctccaaagcatgcagagagaaaatgcggcgggataggctgaatgacagattcatggaattgggtgctcttctagatcctggaaggcctcctaaagtggacaaatctgctatgctagttgatgctgctcgaatggtgactcagttacgagatgaatctcagaagctgaaagagtctattgagagtctacaggagaagatcgatgaactaaaggcagagaagaacgagcttcgtgatgagaaacagaagctaaagatggaaaaggagaacctagagtggcaacagaaagccctgagtcctccaccaacctacctacctcacccccctgccattccagctccattttctgccccaggccaagttgttggcagcaagctgatgcccttcgttggctatcctggaatatctatgtggcagttcatgccccccactgttgttgatacttctcaggatcatgttctacgccctccagtcgcttaagttattcaggcagggatttggtgtctacattctcacagagcactggaagcctttgttgccttgctaactatgattcttgttaattgtcacagataatgtttctgttctttcaattgtcttttgttctcgtagatttgtgaagttttagaatgtacgagtgcaatcactgatgggaaacttggaattcccagcaatcactgggatatcttgtaattttcattaatcagacttggtgattttggtctaaaaaaaaaaaaaaaaaa

SEQ ID NO: 17564 - DNA, 955 bp, Populus trichocarpa
  Predicted polypeptide sequence is orthologous to G791
ttttttttttttttttttaaccaaagtgaaatttttatttattcaaagaaagcgatcccctagttcggagggccccgagtccagctgaggttaaggtgacccacagactttaccagtaacaggtgacctagaagaaaccagtggatttctaaagcctaagattacattgcaatccctggtttgcaaactcaaggaaacaacagctaaagaaccccctacaagtagccaaacctaaaaataggttgccagactaaacttatttaatttacatgtaaacaccagcgacaattaatagaacgtccagattgaaatacaatcagtcaaccaccaaatccagtgagaacttcagcaaaaactaatacagacaaagtaatgacaaaataaatgcacttgttttggtacaaaatacaaaccccattcatagcaggtcgccaatttacgcaactggtgggtggagcacatgatcttgcgatgtatccactgcagctggtggcaagaactgccacatagcaactcctggataaccaatgaacggcattaatttgttgccaggtgcttggccttgagtagcaaatgcagcagggattgcaggaggggcaggcatgaagctgggttgtgagctcatggctttcagctgatgctccagcttctccttctctgccttcagcctctgcttctcatcacgaagctcaatcttctcagcctttaactctttgatcttctcttgaagacttgaatttgagtccctcaacttctgggcttcatctcgtaactgagtcaccatgcggacagcatcaaccaaaatagcagccttgtctgttttgggagttcttccaggctccaagattgagcccaattctataaacttgtcattcagcctatcccttcgcagcttttccctacatgctttggagctagatgcactacatgattcagatctacccctcttcttgga

SEQ ID NO: 17565 - DNA, 905 bp, Populus trichocarpa
  Predicted polypeptide sequence is orthologous to G791
ttttttttttttttttttactcaacaagagtgaaaatttatttattcaaatactgtgcagcgatcccctagtttgaagagtcccgcggccagcagagattaaggggaagccatagacgttaccagtaacatatgaactggaagaaaccagtcaacttctaaagctaaagaaacccctacaaccagtcaaaccgaaacatagcttgccagactaagcttattaaatttacaagtgaacaccagcaacgattcatataaagtccagattgaaatacaatcagtcagccaccaaatccagtgagaaaacctcagcaaaaactaatgcagacaaagcaatggcaaaataaatgcattttgtttgggtgcaaaatgcaaacccaattcatagcaggtcaccaacttaagcaactggtgggcggagcacatgatcttgcgatgtatccactgcagcgggtggcatgaactgccacatggcaacccctggataactaatgaagggcattaatttgttgccaggtgcttggccttgagtagtgaatgctgcagggattgcaggaggggcaggcatgaagctgggttgtgagttcatggttttcagctgctgctccaacttctccttctctgccttcagcctctgcttctcatcgcgaagctcattcttctcagccttcaactctttaatcttctcttgaagacttgaatttgagtccttcaacttctgggcttcacctcgtaactgagtcacaatgcggacagcatcaaccaaaatagcagccttgtccgttttgggagttctcccaggatccaagatagagcccaattccataaacttgtcatttagcctatcccttcgcaacttttccctacatgctttggagctagacgcactacacgattcagatctac

SEQ ID NO: 17566 - DNA, 872 bp, Populus trichocarpa
  Predicted polypeptide sequence is orthologous to G798, G1897
ttttttttttttttttttcgacataaaaaagcatatttttttctatattttcttcgaaagatttgttcgagcaagaacccaaaagctttacaaagaccttaagaaatcacttacacaagaggtatgcttcgaacttcttcatcttctataccataaccctatagtctatacggtcttgctcagtaaacaaaaaacacaacttgaaattaacataagttgcagcaatcaataaaactaaacctccgaggacatcaaaagggaacatgtttttttctttttgggaaaagaaaaggccagtatcagttcaaaccctttcctgctggagcagacataacaagatcaggccaagaaccaaagtaattttcagtatctgctgtaaatccagcttgaagcccccctccttcaacatgatcacaatcaagctgccagggatgacatccagaagtaccaccattaacaagaacattttccattacaggacaggaccaagatcctcttccaccaaatccaatacccatttcactaggcccgaatccaaaacctgacgcgtatccatacccgccaagaccagtaaacccatgctgatcgttagagttcatgagcgaaatgaagtttccatcttcagaaggtaatccgtcattcagatttaacccggctggtacctcagttttcacagctgctaaaccagagtcagtagtcgaggataaaaccacgggcatggattcgggttcatgagtggtggtgaaagcagtcaaaattgcagaattcgaggaagtagaattagaagatgaggtagatattgatgaagaattatttgaagttgagcgagagcgcttggaattcttgcgtgtaccgccaccaacagggacatc

SEQ ID NO: 17567 - DNA, 791 bp, Populus trichocarpa
  Predicted polypeptide sequence is orthologous to G839, G1196
gacaagaatctaattcaagcttacaaggaagcgaacaaggacaggttatgcactgacatcttagagagggaaatgagaaggaatccaatggccgggagtgcctccatcacttcccatacaatggatgatgatcttcacatgaagctgctatacctggagaacagagagattttctatatggcatctgatgcgcacaaagtggcatttgcaagattattcttccctactgaagccaagctagccatggacattggacatgctgcaacaacaccagaatttgctggtcttgctgcatcaaaaggttctaacgggaatttgagggaggttgacctagatgacacaccaataacgcagaacataagacttcgttctaggatggaagccctaacgaaaacagttgaaatgggccgacgatacttccccaattgctccgaagtgctcgataagttcatggaggatgaccttcctgatttgttttaccatgaaaagggcaccccagatgaacaaagaatcaagaagacacgtttcatggagcttaaagaggatgttcagggggcatttatcaaggacaaggctgagattaaccccactaattgttgagtgaagcaagaacaatggaccatgcagtcatggcaagataaggagaggaatcatagcattgactaagatataaggagcacactcttttaatttatgttttttcttttaataaggagcacgaacctttcgctcatcgactatgaatattgtgctttgtcttggaaaaacgaaaaactatgaatgttgagttt

SEQ ID NO: 17568 - DNA, 830 bp, Populus trichocarpa
  Predicted polypeptide sequence is orthologous to G846
gcttgttaaaggttttaattctgaatctgtagaaaaagattcagctgaaatggcaaatcaacttcccagggagatggtggtggatctattgaatcgcgtgacctctgccctctgtcgtgtatgcaatgatccgcctgaggactctgttgttaccatgtgtggccatgttttctgcaatcaatgtgtatcagaatacttgacaggagatgataatacatgccctgcttctgactgtaaagaacaacttggttctgatgttgttttctctgaagctactcttagaagaagaatctctgacacctttgatgctagttcctcacattccaaatttgatgataagtcaatagtccttcagcatgagtataattcctcaaaaatcaaagctgttcttgaggttattcagtcacattgtaaggcagggagtccaatttcagagtttaatggttctgcaggatgcattgaaacatcgatggcatattcaaggttgtcaactgaaggacctataaaagcaattgttttctcccagtggactagcatgttggatctggttgagttttcattgaatcagcattgtatccagtataggaggcttgatggtacaatgactctaagttcaagagataaggctgttaaagatttcaacactgatcctgaggtaactgtgatgctaatgtccctgaaggcaggaaacctaggtttgaatatggtggctgcatgccatgtcatccttctggatctttggtggaatccaaccactgaggatcaggctattgatcgagcccataggattggacagacccgtcctgttacagtaacacgacttaccataa

SEQ ID NO: 17569 - DNA, 679 bp, Populus trichocarpa
  Predicted polypeptide sequence is orthologous to G849
ttttttttttttttttttgacttctctgttctatcaaacttgatttaaaaaaaaaaagttttacagcaaataaattaatgaatgtaaaaagaaaaaaaaaaacactgtagattctgttagagcaggttccttattccatcaaatcatttacaaatgccagcctcacggagtttgggaaggtggcaacgaatcaacctgagcatgaaaaatactaaataaatttgaatactctgtacatctcctgtttcctgtccgtgtcaacatctctttctttgtacatcatattgagtggttatcttcaactccatttctaacagcatgagcgacagtgatctttaatatagcagcctgattcttgctatgttgcttagcttgatgttgagaccagtaagcatgagcagccaagactctgtccaagagctcctggggaacaggctcgccccttctttgctgaggggcaatccgagctgtgtgaaccaatgtcttccatttatccttcaaatccacatatgtgcgatggtctgcatcttcaaaagaacgcaatttaacatcacgccaccttccagttccaacttcctcaactgcatgcacaagtgcttctacttctgacacagagaatggtctcctggttcgacgctgtacaagttcagatcgcttagatttcaggtttaaaggcacc

SEQ ID NO: 17570 - DNA, 890 bp, Populus trichocarpa
  Predicted polypeptide sequence is orthologous to G852, G2633
ggctgactgctttgagcttcgctacttcctcttgagttctttctcctacttcagacaccctataaatttcatctggatttcaactgtaaggggctactccaggatatatgatacaaccatctctcttcaaaactgagttaatttggagaaaatcatgtctttagttggacctgcagaactttctgcaacaccatacggaaatcataagctgtactcactgaaggggagcaatgacaactctggcttgtctgcccaaatattctgccctgataaacgtcagaacatgtatatgaccgattcttactccagtgagagttatgagaagtacttccttgattccccaacagaagagctaatacaaccatcaagttctggcatttcagggaattcagctccacctcaaggcacatcttcctaccagctaagaaagaatttaggttcatccatgtcccctcaagatgatccatacgacgcttgtttcacattgacgacaccctgtgatggctatcaattcaattccgagtcagattacttggacatcgagagcccagatccactaaactatgatgaatataagatgaaattaaagtttcaggaacttgagagagcgcttctaaatgataatgatgaggatggcatgtttggaaatagtcagagcatggaaatggatggagagtggtctgatccaatccagaatgggatgctccatgattctcccaaggagtcatcatcttctgattgctttttgaatgtgctaatgcaatctcagagggaaacattgagaaagcatcaacttttataaacgagctccgtcaattggtgtcaattcaaggagatccctcgcagaggattgcagcctacatggtggaaggtcttgcagctcgtatggc

SEQ ID NO: 17571 - DNA, 964 bp, Populus trichocarpa
  Predicted polypeptide sequence is orthologous to G852, G2633
ttttttttttttttttttggtgtcagctctatataggaagagaatgttattaaattttgaagtatgcaatagaattacattgactatgacatacaaatattacaaaaacccttctgctgatgaccttacagtttaaacactctcctaaaaaggggcacgcaccattcccacctatgaaaagtacatgtagttaatacaactatatagcatatccaaccttcatctcctccgatatcaatgccaggcagaagcagatatcaaattcctatctttccatcccaacagcatagctccatcattttccaccaatgtatagtgctctgagtaagtcctcagcaggctctttatcacagagttcacatatgtgctcaaagggtattgctggaaacctgccatcatgaatctagacttccacttgcgaaagagctcgtggcgctccaccctctccttcccctcacaagcaatgacatttaccatatccctggctagacaatgctgctccacactaatacgctcctttcgatcccttggcagcgtcacatcaatggattcaaacattgccaagtaatagtttagagtttctacaaaccgagtgacgaaaggggttgtgtttgtatttgattcttgctccaccaaagtgactaacttgggattgaatgatttgatcatacgaagcagcccatctcttgggttgttcacatcaacactttcatcaggagtatggtggagctgcaagggaaagtttacagctagagcctctccaggcctaacgtcaagcatttcctttgtcacgtctggagcaaaaactggtaccccatgaaactctacagggatattaaatttctcagaaattgcactcaaccgtctcgcaactgcctctaatccatccccacgggcatatttagaaacaggatcatcaatacctgtaatacgcacatgtggagcaccacttggtctggctgca

SEQ ID NO: 17572 - DNA, 504 bp, Populus trichocarpa
  Predicted polypeptide sequence is orthologous to G852, G2633
ttttttttttttttttttacaaaaagaggaaacagacctcatcctcaatataaacattggcatggtgtcagctctatataggaagaggatgttatttaactgcaatagaattacataattgacaatgactgaaaaatataactcagccaacctttctaatgctaacctcagttttcccactctcctaaaaagggtaatgcaccatccccacctatgaaaagtatatgtaattaatacaactatatagtatatcctacctccatctcctcctatctcaataccaggcagaagcagagatcaaattcctatctttccatcccaagagcatagctccatcaatttccaccaatgtataatgctctgagtaacaccttagcaggctccttatcacagagtttacataggagctcaaagggcattgccggaaaccggccatcatgaatctagacttccatttgccaaagagctcgtggcgctcctccctctccttcccctcacaagcac

SEQ ID NO: 17573 - DNA, 918 bp, Populus trichocarpa
  Predicted polypeptide sequence is orthologous to G861, G1140
ttttttttttttttttttggattaattaattttttaaaagtttactaaactagcgtaaaatgaacgctttaaggtcgtttacaggattaatgtgtaaattaattcaaggattctttacagtcgatttaaagaagaagaagaccacaatgaaggggattctctgttcagtattggtacatatgttaaaattaaatgttcttttctattatttatttagatcaagctaaaaatacttttgctggatgagcctccatctttccgattcaatcacgaaaaggtaaccctagagtaagaaaaggatcaactgagctcatgctcctggtattggtcaccagagaatctgatgacttgtctggttcgagcaaatgcctttggcctgctgataaattcatcacttgctgcctcaatcgccggttctcttctactaattgctccccctcgttcttgagagtattgatctcatttataattttaccccccttttcttccacgacgcgacacaagcttgtttcgattaatttttctaatttatgtagttcttccaagttcaatccttgtaggtcttctcccctcacctggctcagttcacgggttttctcggctatttctttgttcagcgtggcatacacagcaccatcaggctgcagctcaagagatggttgaccgaacatgtcgatgttctttggatgtagattgcgcttttcaatcacttgccccatgcttgagtttgagtactcataaagcttgccagatgcagaaaacaccatgagagcaatctcagcatcacatagagttgagagttcataagctttcttgaaaagccctcctctcctctttgagaaagtaacttgccttggcgatcgtgtcgtctatcttcttggatctggattttccttcgagtcatcttccccaagtaaa

SEQ ID NO: 17574 - DNA, 902 bp, Populus trichocarpa
  Predicted polypeptide sequence is orthologous to G861, G1140
ttttttttttttttttttgcacaaaatgggctgcaaacccttgtgcacacaataagagaaactccatgagtagcatccggtaaaggaaacagaaatgtttccccgcacttgtccaaggtacacaagtactatgtgcctgagttatgttcctgttctatttatatatacaagcaattatttgtgtccgcatttgctggtgaagaaatctccctgcgatctcccattcagtttgaaaatggcaaccccaacttgagggatgtatcagagctttcataatcatgtagagggccatttgagttgcagacattggttacggactctgatgactgcccttcctcgtaaccaacattctctgaatcagctgtaacatgctttcggccattagatatctccaccacttgctgtttgagtctctcattctcttccatcaattgcattccctttctttgaagatcagtgatctcgttcataatcttctcacccttcttctctatcacacagctcaatccagcctcaagagacttctctagctgcagcaattcgtctatatccaatcctcgcagatcttcccctctcatttgcctcagctgatggcttttctccgcaacttccttactcaacctggagcaggtgctgtcttctaccagctgcaactcaagagatggttgctccagcttctcaagattcttcgagtgcaaattatgcctttccagtatttccttcatgcttgagctggagaactcaaagagcttgccagtggaggagaagatgatgagagcaacatcagcatcacagagaactgaaagctcctcagctttcttgaaaagccctcttcttcgttttgaaaacgtgacttgcctagcggtggcgttatcgatcttttttatctgaatcctctctct

SEQ ID NO: 17575 - DNA, 553 bp, Populus trichocarpa
  Predicted polypeptide sequence is orthologous to G861, G1140
ttttttttttttttttttggctaaattcgtatatattactacatgtttcaacagctccacctcatttcctttaccttaaggaaatatgggaacccttgattcataaatgcatatatacacaaccacacatgatctgtatcttaaaccctgtgaatttcctgaatcaacaagcaaatattaaccacgtacaagccaggatatatgaaggttttatttgaaaaatataacgactgcaaatccattaaattttgttggaaaatcctccatctttcggattcaatcaggaaaaggtaaccccagtttaagaaaagaacaagagttgtcgtagtcctgacgaggataagctgagttgctgctgatattggtcaccatagaatctgatgactggccttgttcgagcaaatgcccttgtccctttgataaattcatcaatctctgcgtcaatcgctggttctcttctattaattgctgctccttggacttgagagcatcgacctcctttagaattttttctccctttgtttccatgacacgacacaagcttccttcaatc

SEQ ID NO: 17576 - DNA, 493 bp, Populus trichocarpa
  Predicted polypeptide sequence is orthologous to G861, G1140
ttttttttttttttttttgatcactttacagttgatttatttaggaccatgttgaagtcccccttacatattttcagttctaaatttcatacacacatcacaaatagcatgatacagtagttcttcaggtgaagaaagcgaatccagcttcattgtcacatcaactcaaacatatataaataccagtatctcatgggataagtcgatcttccagcgatagcagatctgttcctcgcaagattctactggatcagttcattttcctccagctttcagcatcagatggccaaccctaatttgagagaggtatcggagctatcatcctccacaggagggccactgctgcagctgcaaacattggttgtagactccgatgacatcccttcttcctgaactgctgtgtctaaatcgacaagggcgggtccttttcccttgtaaatggttgcgatcttctgttttagttgcttattctcttccaaaagctgtactcccc

SEQ ID NO: 17577 - DNA, 856 bp, Populus trichocarpa
  Predicted polypeptide sequence is orthologous to G865
gcacccaagcccaacactaacagtcctttgatctgattcttgatgtgtagggcttattcagaagctgcaaatctagcaaagcaacagtcatttcatgccctagtgtcaccgtcctaaaaccaaaagatttagcatcaactgtcttttttcaaaggtggatcgcaggtatggaaagaggccacttccaccggaagcatcagaggagaaggaaaaggaacttgatgacttcccttcttattcttccacttggtcagagacagacatgtcttctatggtttcagctctcactcaagctatgggtactaccgacaataacgtcccaatggtgcaatcaaccccattcgctctccatcaatccgtcgtcaaaggcgaacctgaccagtctcaaccagtgcaagatcaagaaaatacaaggagaaggcattacagaggagtgagacaaagaccttggggtaagtgggcagccgaaatacgtgaccctaaaaaggcagctcgagtctggcttggtacttttgatactgctgaggatgcagctgttgcgtatgacaaggcagcgcttaagttcaaaggcagcaaggctaagcttaattttcctgaaagagttcacgagttcggctacttcatgagttctggggcttcaagcaatgtcatgactgaacaaaatcctaggccagttgctccccctccccctcccccctcatcatttgcaccagacacttacccagacttgcttcaatatgcacaaatcctttctagcaatgatgccaattttccgtactacacttcaaacctctttaatcaacaacctttcccccggccatttttcacaaagctttctatcacagcaacaactaaa

SEQ ID NO: 17578 - DNA, 881 bp, Populus trichocarpa
  Predicted polypeptide sequence is orthologous to G866, G883
gcttcttcctctctctctagcttcaagtgctgggttttgttcttcttcttcctcgtctttcatcatggctgtggatctagttaggtattcaaagatggaagatcagatggctatacaagaagctgcatcagctgggctcgagagcatggagcacttgatctttgcactctctaaccaaactcgacaaagccaccaacttgactgcggagaaatcacaaacttcaccgttgctaagttcaagcaagtcatctccatgttgaaccggaccggtcatgcccgttttcgccgtggaccaacttcttctccttcttcctacccggttcccgtccgacctgtccctcaagaacctcaaaaactgaaccttgattttgttaacagtaatagcccccctaaagctgagtcgaaaaatgacctgtctttgggtagtcagtattcaaaggatagccttagctctggcaccactacctcatccttcgtgtcttctgttacagctgatgggagtgtctctaatgggaaacaaggtggctcttctcttttcggaactcaagcgcgatctaccggaaaaccacctctctcatcgacccaccgcaagaaatgccacgatcatgccctctccgccagaaagatctcctccggtggaagctgtcattgctccaaaagaaggaaatcaagggttaagaggacaataagggtaccagccgtgagttccaagattgccgatataccagcagatgagtactcatggagaaaatatggtcaaaagccaatcaagggctcaccatacccaagagggtattacaagtgtagcagtgttagaggatgtccagcaaggaagcatgtggagcgtgccgtagatgactcggccatgcttatcgtgactt

SEQ ID NO: 17579 - DNA, 921 bp, Populus trichocarpa
  Predicted polypeptide sequence is orthologous to G866, G883
ttttttttttttttttttaatttaaaaacactttgatttactttgaagatcaccttgggagattaagattccccccaccgctatcaataaaaatttaatatacaaaatcagacaccaaattcaaccatcttgatattacaaaagtctaacttgtctcttttcctaaagcctaatctctctcctcctttattcccctaccatcatggttgactcgaacaccaagttaacagttccggcagccatgttaccctccattgcaccttgagtatggcagtgctctccctcgtaggttacaatcaacatggctggatcatctgttgctctctccacatgtttccttgccgggcaccctctcattgtactgcacttgtaatatccccttgggtatggtgatcccttgattggtttttgaccatattttctccaagaatactcatctggtggaatatcagctatttttgaacttattgctggaaccctgattgttttcttcacccgattcttccttctcttggaagagcaatggcacttgccactagaggagccagagacagtgtcatcatgatgatgctcatggcaccgcttcttgttgctgtacggcaccgtcgagagcggcggcttgccagcggatcctaagaaaatcgacgatccttgctttccattagaaacgctgccgtctccggttatccccgacgacataaacgacgccgagttcgaagagacactgaaactatccttcgagaactcaatctctgcactcttggagctaaatatattcggtttcgtgaaatcaagcgtcagactcgtcggcgccgccggtgcggtgaccggagttgtgatttgctgtggagttagggttaggttttggaagcgagagaaggagggggactgagactgtgattgcggtgattgtgtcgatgt

SEQ ID NO: 17580 - DNA, 710 bp, Populus trichocarpa
  Predicted polypeptide sequence is orthologous to G877
ttttttttttttttttttggcatttcctgttgtcatctgctctggttgtcccagaaagagccctttagttctattctccccagggggttctgtgattgtacttgagttaatatcgtcacctaacattactgagaaaaatgctcttgggcttggactaggaggtacccagtcaccaattatagcaacattatcatcaatcccagccatgtttccaaaaccttggaacaaggtctgaggcagctatcagccaaggcgttggggacggctaagttcctgattgattaaggagtcaggctaagatgatgatatcttaggaaaaagacccaccaccacacctcaaccttcaccaccaccaccaccaacctgacccttcaatgaatgaagtccggttcctttgatcacctctctgtttaattcaatagaaatggaaatgacccacttttttgttttagcccaaaaatgatatgatgatgtttattgattttgaaaaccaaaatcacaaaaaggaatcacctttatttatttacagtcaagaggttttttataacaaaaataaaaaccaacagacagggttaaaaaggagaggagatgattgtggaaatggaatggtgggggaccagaaatggatggaatctttgaagaatgaaaaggaaaagaaagcaaacaacaaaagctttatggaacagcatgtttcatcttcttgtttctac

SEQ ID NO: 17581 - DNA, 871 bp, Populus trichocarpa
  Predicted polypeptide sequence is orthologous to G896
tccgctccctagccaatagagattagaacacatctccattaataaaccagaaatatccataaaaaacacctaacaacaaccataatgtatagttacatgcttgtaaattgttccaaatgccagactccgctccagctacccccgggtgccgaatccatccgctgtgttatctgtcaagctgtaactcacgtcgctgtccactctcgccatgctcctccaccatcaaaccccaccactcgtcctcctccttcgacgctcgcaccaccgtccccctacaaccacgcgccaccgggccctccaccaaaccaacacggaagaaaaaaggcagttattgttgggatttcgtacaagtactcgaggcacgagttaaaggggtgtatcaatgatgcaaagtgcatgcgtcatcttttgatgagcaagtttcagttccctcaagattctattctcatgttaactgaagaagaaactgacccctacagaattcccaacaaacaaaacatgaggatggcattattttggcttgtacaaggttgtcaacctggagattccttgctttttcactattctggacatggttcaaggcaaagaaattataatggtgatgaggttgatgggtatgatgaaactctatgtccacttgactttgaaactcaaggtatgattgttgatgatgaaatcaatgcaacaattgtcagacctcttcctcatggtgttaggcttcacgcaatgattgatgcttgccatagtggcactgtattggatctacccttcctttgcagaatggacaggaacgggcagtatgtatgggaggaccatcgtccgcgatcaggtatatggaaagggacaaatggtggagatgtcatttctttaa

SEQ ID NO: 17582 - DNA, 862 bp, Populus trichocarpa
  Predicted polypeptide sequence is orthologous to G898
gatttattttgacgattttgttttctttgcagagtcaaggtctttataggacttttgtatgaagcttgttgattgagcatgagcactcagactcagggggtgaagagtcctcctttaagggggtatcggcgaaggaagacagtgctggacttaaacgcccctcctactgaagggaggggtgatgaagggacttcaagccgaactgaacctcaaggagtgcaagcaagccaacaaggacagtccttgccacctcctactattgatgttgatgtgttcgatgatgatgtcattgaatcgtcacccacagcgtttgccgaggctaagaacaattctcgaagagctcgtggaagggctgtcgttgttgatgtagagtcagggcgaacaagtagattgtctcacaataacctcaactgtccaatttgcttgtgtccattggttgaggagatgtcaacaaaatgcggacacattttctgtaagacttgcattgcagacgcaatcaaaagacaggctaaatgtcctacttgtaggaaaagggtcaccaataaagaacttattagagtgttcctcccagcaaccagttgattttgatgctcgcattcaattgctgtttatgtttaaaagaaagaactctgagacagagggatatagatggagcaatggctatggtggatcctaatttttcgtgtgaaggaatttgtctaacttattgtgcagctcaaaatgaaatgcctggtggcaatagtggttttgttattggaataaaatttatgtttaatggatgcatatcagtgatctgttttcgtttactgttggctaaggtacgtagtgactagattgcagaggaagttttatgacatttata

SEQ ID NO: 17583 - DNA, 951 bp, Populus trichocarpa
  misc_feature (739)..(739): n is a, c, g, or t
  Predicted polypeptide sequence is orthologous to G898
aagatatttagcagtcttttaaattaagttaaatcaaagtctacacttacaaataaaggaatttttaaagaaatgcaggaagaaagatcctgaagatggatttcgctatacatttcatcctgcaagtagggcacttcttctggacagccagtgctttttcaatgcaactcttgcagaaaacatgaccacattttgtcgatgttgcttctttcatctcgtccatacaaatcgggcaacaaaacattggtgctggtggcggcggtgcagtttgggacaatcctgaaaaatggggcggtggcaccgtcagggacaatccagaaagttggggcggtggcacagtctgggacgatccagggaactgggatggtggcacagcctgggatgatccagggagttggggcacactcccagcttgatcaaatgtgttgggggagattatagcaatatcatcatcaatgacctcaacatctcgagcagttccacgttgtcgtgtcaatccatatgcttcagcttgaaaaatctgtggttgggcaggaaaccacgggccacagggaggtatattgttctcaacaggaactggaaagttgagatcaaagtgctgatagtaacttctctcggcttcccacaaattttcaaccagaagatccacactccccagtaaatccatagtgttttctgctttctccataaaaaccatgttgctgtcaaaattctccagtaaatccatggtgtggagcanagggacctaaaattcctgtgaattggggtgcgaccaaccctaataaatcttcaaacaagccagagatatgatcggtgatggattaatttaattatagcaaacaaaagttaactggagatttttaagactattagggaaagagaacgtgtgctttcctttttgcacagcccatgatatttcaagaaaactgatgcgcatgtgccataactgcc

SEQ ID NO: 17584 - DNA, 763 bp, Populus trichocarpa
  Predicted polypeptide sequence is orthologous to G904
ttttttttttttttttttgcccaaaaagtacgtagaggaatttatacttgcaaagaaaagaaaaaaaacatcttatcaccaatttgaaacctaatttatatcatagttaaagccttgagagaatgaatcaacaggccaaagttttgaaaaaaacagatagagcaaaccatattacctggacaagagcatttataatgacaagggggtcaaattttgagcagtaactcgcctcaatttaccatatacagcgggtgagaacatttcatagaaacaaggccaatcgccaagtctttatcttcagttaaagtgtaatgttcatccctgacaaccttaattaatgcacccataagcttctttgattgaacatctgctttcaaaactacaattcgatcttctttgagaagaatcaccacaatatttgcctccagtctctccacttgaccgatctttgagatgcttgctttgttaagaccacagcaatccgtagaaacactggctgactcatcagtgatggtgctgatctttgaagtaggaatactatcagagacagaggaagtttctgtaggagctgaaacaactggatttaaagctaaaatagagattgttgctgtttggcaacaatgattagcatcagaaatctctgagactggagatagatcataggattccttgttaattttcggggaaacgtattgagttgtcgacctaaactcaccgtcgaagcttttctttggattctacacaagtcacagggccagttagc

SEQ ID NO: 17585 - DNA, 523 bp, Populus trichocarpa
  Predicted polypeptide sequence is orthologous to G912, G2107, G2513
cggaatctcaacactctcacaagtcattcattatccgtgcccaaaagttcaaagcggacccataaaccctatacaaacatcactagctcttaaaaaatggtcatgggaggatcaaatgcgttctcacctgacaagcaagaatcatctttatcatctttactatccgatagtagcgggtctcagcaggactcgcccagttcgaacgagaaagtcttactagcaacaagtcgtccgaaaaagcgtgcagggcggaggatattcaaggagactcgtcatccaatctttagaggtgttaggaagaggaatggcgataaatgggtttgcgaattgcgtgaaccaaataagaagtcacgtatatggctaggcacatatcctacacccgaaatggcagcccgggcacatgatgtagctgctttggcgtttaggggaaaatcagcttgccttaattttgcggactcggcatggaggttgcctgtgcctatttcaaatgaggccaaggacatcaggagggcagcaagtgagg

SEQ ID NO: 17586 - DNA, 921 bp, Populus trichocarpa
  Predicted polypeptide sequence is orthologous to G912, G2107, G2513
ttttttttttttttttttgacagtaaccctaaatcttattactcacttcaattttcacactgctgcagatttctaccaaacaatccaacccagaaaaccagaggtatgacaatatttgataattttatccgtactggcaaaaatataagtccggattaccttaattatcatcctaattactctactaataactaaaaatattaaacagaaaaactccataatgacatgtcggtgtcattattttccatgttatccaaactatccccaccggaataaccacaacaattaggtggcggcaataacatcccttctgcaatattagccaacaaacctggcattccaaaatctgcatcatcatccatataaaacacatcccccgccgccgtccctgcaaccttctcaacctcatctcccgtcctcgttaactcaactcccagactcccctccggccggaaagcctctgctgcctccgctgcagccttctgaatatccttagcatcgctggaagccggagtaggcaacctccaggcagaatcagcaaaattcaagcaagcagacctccccctcaacgccaaagcagcaacatcatgtgccctagcagccatatcagccgtaggaaaagtccctaaccaaatccttgatttcttattaggctctctaacttcacaaacccacttacccgaattcctcctcctcacccctctatacacaggatgccttgtttccctaaacttctttcttcctgccctcttcttcggattcctggaagctaatattacttcctcatcagaaaaaattgcacctggttgaactcctttagtaacactactagtgatgctactatctgaaagaacagaagaataagaacattcttgctcgtcaagaactgacaacaaactcattgacccaattgggttctga

SEQ ID NO: 17587 - DNA, 962 bp, Populus trichocarpa
  Predicted polypeptide sequence is orthologous to G912, G2107, G2513
ttttttttttttttttggggcttaaaagcagaactctctcgcatttaatttgtttattcactattacagtaatagattatggcttagccattattacatgatgcgattgtgattcctttgacacacgaacagtaaccctacatcctgtagcttcttcaattttcactctctcccgcagatttcttccacacaatccattctaacccagaaaacctaaaccgccacaatattcaattgtatctgtactagtaaaaaatataagtacagacaacatcgactcttatcttaattactctatcacttacaaaaaactatatagaaaaactccataatggcatatcagcgtcaatattttccatgttatcccaaccatcccctccaccaccacaatgaggtggtggcaataacatcccttcagccatattagccaacaaccctggcattccaaaaacagcctcatcatccatataaaacacctcctcccccgcctctgcagtagtccccgccgccttctccccctcatctcccgtcctcatcaactcacctcccacacacccctccggccgaaaacccccagctgcctcagctgcagccttttgaatgtccttagcttcactagaagccggaaccggcaacctccaagcagaatccgcaaaattcaagcaagcagacctacccctcaatgccaaagcagcaacatcatgtgccctagcagccatttcagcagtagggaaagtccctaaccaaattcttgatttcttattgggctctctaacttcacaaacccacttacctgaattcctcctcctcacccctctatacaccggatgccttgtttccctgaatttctttctccctgccctcttcttcggattcctcgaagctagcattacttcctcatcagaaaaatttggagctggctgaactcttgtagtaacatactactaatactactatctgaa

SEQ ID NO: 17588 - DNA, 778 bp, Populus trichocarpa
  Predicted polypeptide sequence is orthologous to G913, G976, G1753, G2514
ttttttttttttttttttgcagatggaaagagagacgtactctggctctagctgacacatttaaatatatacaactaacaaatgtggcagcaaaatcgattcaccaaccagtttttacctttatctacacaacactccattgcctattaccccatagaaaaatctttaataaaagccaaccttttgttacatcatgggaccaaaacctctccctttgaccaaaaccaagaagcaaattctccatggagaagctgtttgggtttgctttagtggtaggaccataggctttcagcatcggaactccctggtgaatcatcagaagatagtgtgtttattcttggtgggcttactagcattcctcctgccatgtcaactagcaaattgggcatgtttaaaagttcttcctcgtcgaaaatttcctgtcctgattgaacatcagcagtgataatagatgatgagccttctgtttcaggctggcccatctcagggtttggcccactttcacgcttgggtgacctggctgatgctgcactagcagctgcagcccttatatcactaggggatgctgaggctggtgttggataggaaaggattgattccgggaaattcagtggcgtgttggtgcctttaagcgctagagcagccacatcataggcggtggctgccatctcaggagttggatacgtaccgagccatacacgcgtagttttacgtggttcccggatctcggatacccattttccactccgtaacctaacacctttaaaagtcgggtgtc

SEQ ID NO: 17589 - DNA, 925 bp, Populus trichocarpa
  Predicted polypeptide sequence is orthologous to G921
ttttttttttttttttttctttttaaataaactctacgatttatttattttttcactttaattataagtttcaaactcatatgatatatgtacgtacatcgatcactcacatatatataattaaatattcgaagtaatatataaaattctaattttttttaagtaatttcaccatttctccatccgagtctggttgaatctcccagagatagcagctgcaagcgcagctgtaaaatttggatctcttgtcaaagaagacgccatttgttggaccaaaattttttgaagtgcaggcacttccatttcttgaacagtctttgtagcagtatctccatgccttccactttggatcaaatcaagggtcacagtaggagctgaacttctgatcggtgattgtgtgggaatcggaccaaaattagaaccgtggctcgagcctagtgatggttcatgttgagagtggctagcgtggttgtgctctccttcataagttgctaccaaaatagaagggtcttcagcacttctttggaccttcttcttgacagggcaacttggggcaaatgagcacttgtagtaagccctaggagaaggattgtctctggtcaccttctggccatattttctccattgatatccatccttcacaaccaagcttgcatcggattcactagtcctaaagtaagtccttgaaatctttgatttcagattctcctttggccttttacttgactcttcatcaatagaactgctctctgcatttcctccacttattccattaatcacgatgctataatcttcactctcagcctttctcttccttgatgatattggtgtactgatttcttttacagaattcttgctcaccaaatcagctaaatgtttttgcaaagccatatagttatcgcatacaacacccaagcatttctgt

SEQ ID NO: 17590 - DNA, 938 bp, Populus trichocarpa
  Predicted polypeptide sequence is orthologous to G921
ttttttttttttttttttgaaaaacaggccattatccattaaatgggaaaaaacccaaatccaactattgaatctcaaaatgagttttggattcttcatgtaatcatatacaatcctcaaggtgctatcttccttgggaccttttgttcccccatgtatcaaatgatgtatttacaaatacattgccaaattcaaaatgatcttttttcggattacaccccttatctcaagttttggactctctggataataggtactgtaactggtattcctgtgtactaatggaaccctacataatttataaaactccaactaagttggtagagataattcttttcctatctaaagctgaaatttcaccacttctcgctgtgattttgctgaaacattcttcctgagattgctgaggccagtgctgcagtgaaattgggatctttcgtcagcgaagaggccatctgctccaccaagaatttccggacttcaggcgtatccgctcttggttttgagctcctgtcatcattccttgacttagattttgtgagatcaagagtaatggttggcccagatgaggctagggaggctatgcagggtgctggaccgagtgttagactacggtttgaacctgatgttgcctccattgaaggatgtggatggttgtgctctccttcataagttgccactagaacagattggtcatcgatactcctttgaaccttctttttgacagggcagcttggagcaaaagagcacttgaagtaagctcttggagaagggttatctcttgtgactttttggccatatttcctccattgatatccatctttcacaataaggcttgtatcaccagcttcagtcctgacataagccttcgaaatcttatctttaatgacttcttcccttggtttcttggatgattcttcatcagttgagctactctc

SEQ ID NO: 17591 - DNA, 860 bp, Populus trichocarpa
  Predicted polypeptide sequence is orthologous to G921
ttttttttttttttttttatatcaaaaactgataattatccattaaaatggcaataacccttgcttttcaaattgagtttggatccctcaaaggtgctatctttcttgggatgttttctccgtgtctcagatgatgtatttacaaatacattgtaaaattcaaaatggtctaacagaacctacataatctaattatagaacctacatagtttatagaactccaagttgtatgagcttcttctcctatctaagtagaaatttcaccacttagtgtgattttgctgcaacattcttcctgagattgctgcggccagtgctgctgtgaaattgggatctttcgtcaacgaagaggccatctgttccaccaagaattgccggacttcaggtgcatcagtttttggttttgaacttttggcatcattgctggacttagattttgtgaggtcgagagtaatattggttttcccagatgaggctagagaagcggagcagggtactgaaccgagtgttagaccatggcttgaacctgatgttgcctccattgaggggtgtggatggttgtgctctccttcataagttgccaccagaacagattggtcgtcaatgctcctttgaaccttcttcttgacagggcagcttggagcaaaagagcatttgaagtaagctcttggagaagggttatctcttgtgaccttttggccatatttcctccattgatatccatctttcacgataaggcttttatcacccgcttcagtcttgacataagccctggaagtcttagctttgatgacttcttcccttggtttcttggacaattcttcatcggttgagctactctcagagttcccattcattgc

SEQ ID NO: 17592 - DNA, 878 bp, Populus trichocarpa
  Predicted polypeptide sequence is orthologous to G922
ttttttttttttttttttctttttttttttttttttttttttttttttatcatccaatctctatcaaaaagtaaataaggaaatatttacaaaaatgttaaataaatggaggaaacgtttgaaacttgcagcaaagcattatgcaactgcgcattaaaagttatcaccctttatacatataacagtaacaaaataaaagaaagcacactccccatatgtttgataatctctcagtcatacctcctgaatctccaagctgacacaaaaaaaagcggtctatcctgccagcaaataaccaaacatccgttttcttctttgattttatatccgtcatagccataactctgcaaaaacctgtttgcctgcagcctaccatggtagctcaaaggaatgatcccgaatccagccaactcgagccttaaaatccacttttccaacttctcatgcctctcctttctatcagttccctcacaagcaatgatgttcttaatttcctccccaaataacatcttctcaaccttatgccgctctaatgatactcttgatacagtaaactccaaacaatcaaatagcgcagcataaaaattcaatgcttctgtgaccctctccattaaattaaacccattatgatttgattcttgctcagttatcaccatcaattttggtgagagactcctaagtgcatttagaaagctgcccatctttggtgaagcagcaagggatagtggggataatgctgagtcaggacttgagctataggcattaaccacatctctctcaagccaatcaccgagagtgcgtcggttttgattaatctgtactctctgaaaatggttagagtttggattcttatatcctgatggagagttccttctatg

SEQ ID NO: 17593 - DNA, 867 bp, Populus trichocarpa
  Predicted polypeptide sequence is orthologous to G926, G2632
ttttttttttttttttttggcagggtaaaagaggtaaaccctctgttcacacataaagaaatgatcacacgaaagttaagttcaaacgcagaccactggaattactacatttgggattaattcctgcaaggtagatacactagtttttgccatatttacagaagcgacgaaaagaagagagatgcaattagttcaagtctgaagacagcatgaagtccatcacaacatatgatatgctccactcacaccaccagcatgcaccaagtaacaaagacccaaagccaagaatgaattgcctgagaaacaccacacgctgaaagtttcgccccccaagttggacatggctgatgcctccagctttgcaactcaaggtggaaatttaataaatggagacgttcccattagacaccccattcccatgtgtggtttccttctgctgacccaagaagctgccatcatctgataatgaatgatatcttgatgagagtccattgccattaccatggcaattggaggaagcgtgtgtttgcatgtcttgaaccatggactcttttccttcctgcagatcaccggaggaatccaaatctccagtacctttatctgacgttggattggcagcattatgatcaagcttctttgtattaaggaaacggcctccacaaccccttgcccttctcatagcatgctggtgtcgagactcatgaagatatggctttctaacttttactgctttcttttcaagctctgccttagcacgtgcctgtcttcgcctcataataccattaaactgttttgcatttacataaacaggttcctcttccatttcaaggggcaaaggcatcctggcgtgagtcattccatctggga

SEQ ID NO: 17594 - DNA, 839 bp, Populus trichocarpa
  Predicted polypeptide sequence is orthologous to G926, G2632
ttttttttttttttttttggctaaaatctaaccagagactacttctacttgagtttccttgacagttctatgtacacaggaaaaaggagagggggagagagagagagagagagagaataatgatgcacgcgaagcgttggcagacaaaagaagccaaccacggattcatcatctccttcactctgttcaagccacaagcaagaaaaagaaaaagccaagaatgatttgccgcctggcaatatatattgccaagtgcgtggttgcctgataagagagaggattcaagtttcgctacttgcgtgaattggaccctccaccttggcatccacttaacatgctgggttcactgtgggccaaaaaaccttcgtttggcctggttccccagttgctggcctggacagtcttcgtcctcattttcacctgaacggtctccatcctcattgtcacccaggtaagagccatatgcagaggattgcaagccactgtgtttttgatagtggccacctctatttacatagtcatgagcttcaaaagtgtcatgcacttgggactctcttgcttccttttgaccttcagaggaattccaagtttcaacagagtcagagggcaagagttcagaacctgatgaactccgtgactgagatgcatggaccggaccagaaccattgagcttgccttcggatgtgttctttgaagcatcatcaccagttttcttcgcaaaacgtcctccagaactcctttcccttctcatagcatgccggtgccgagattcatgaagatatggctttctagcttttatcagcttcttgtcaacctctgcttttgcacgttgttctctt

SEQ ID NO: 17595 - DNA, 864 bp, Populus trichocarpa
  Predicted polypeptide sequence is orthologous to G926, G2632
ttttttttttttttttttgaaataaccagtgctacattgaattgcaagtgatcgaacaagacagtttcaattttcaaagttaaactaaagagctgataagactaaaatctatccagactacttctagttgagtttccttgacagttgtgtgtacacaggaaaaagaaaaaaagtgagagaacgagaataatgatgcaagcaacccgttggccgacaaacgaagccaaccacggattcgccatctcttccctctgttcaagccacaagcaagaagatgaaaaaagccaagaatgatttgccgcctggcaatatattgtcaggtgcgtggttgccagataagggaaggattcaagtttctctacttgtgtgaatcaaccctccagtcctggcatccacttagcatgcacggttcactggtgggcagaagacgttttggcctgcttcctcagctgccagcctggatgatcttcatcctcgttttcacgtgaacggtctccgtccttgttttcacccaagtacaggccatatgtagaggattgcaagccatggtggttctgataatggccatctctatttgcatacccataagcttcaaaagtgtcatgcacttgggacgcccttgcttctttttgaccatcagaggatttcaaagtttcaacagagtcagaggagaatggttcagaacctgatgaactccctgactgagatgcacgaagtggaccagaaccattgagctttctttcagatgtgttcttggaagcatcatcaccacttttcttcgcaaaacgtcctccagagctcctttcccttctaatagcatgctggtgccgagattcatgaagatatggctttctagattttatc

SEQ ID NO: 17596 - DNA, 579 bp, Populus trichocarpa
  Predicted polypeptide sequence is orthologous to G927
ttttttttttttttttttgtagccctaaatgagatgaaatttataataatagaaatactgaacataacacaaatacttagttatttcttacaattaggaatccatggagtagatatcaagcttcaagagcatcaatcattcttaaacataattttgggtagagtctttgtttcattgatggaaacacacccgtttattatcttgtccatttgctaaaaattttacagtgcattaaggatttagcacctctaaccagcccatgacagcaaggttgtatggaatggaaaagatgccattaatgcactagagccaagaacgacttgccctaacaaccaaatggtgaagtccaacttcaagccataatcaggttgcaggttcctgcaaaggtggggtctggtctagttcaagaaacaagcaccaacccgatttttgttcccttgctattttaagttgcagcagttgtcagctgctgcaacccacttactgggcataacaatgccatgtcctctgtccatcatgcctgagaaactatggaaagttggcccaagacgattgatctgaaggaggtcaagttctccc

SEQ ID NO: 17597 - DNA, 830 bp, Populus trichocarpa
  Predicted polypeptide sequence is orthologous to G927, G1334
ttttttttttttttttttggatctctaaaagatcgatatgatattccaagattacacgaaccctttttacataaactgagaaaagaaagtgacaaacaataagccaagaatgatttgccaacgatatatagtcttcctcaccaagtgagtcagggtcgatgtttctagctttttctaaatggttataaacaatccctaatgatcgaagaaacaccttcaacaggatgcaagcaagaaagcatagagcggtaaagacatacgcccaacaaatccttactgcgtgtcaagagtgaataagcaaactcaatgaagaggcaccttgatttctcagagtttggtagaatccaccacacctttcagctaaacgggctttcatacaattaacaatgctggagagaccctcaactccttgtgctggaagtttcaattgagaggcctactcactcaccataatttgttatccctttctcccaccatcttttctgaaagtgaaggaaatttggaaaggtgatacctgggaaactgcggggtgcatcctttgctcagatatgtctgatgagggtgcatttgacacagagactctattacttccgcatcattactcattgacgaatcagagtttctggaaaagtgagacagcacaggtccagagcttgatgagctggtaaagtttcttgaaacagtttcatcagagctggtatgcttatcaggtgcagtattattggtagtgtcaggtttctttgtgttaagaaaacggcctccacaacctcttgcccttctcatagcatgtagatgccgggactcgtgaagataaggcattcgtttgcccc

SEQ ID NO: 17598 - DNA, 875 bp, Populus trichocarpa
  Predicted polypeptide sequence is orthologous to G928, G931
ttttttttttttttttttggactttaaagacaaactcttttcaaccatgttgacaaacggaggatgtatatatagaaagaaagcaaacagcagagaaatcaaatacataacagtgtccttcatgcactttttgtaccaagtaaagacacaaagccaaggatgaattgcctggaccggtgacacggtcttcttattccgcattttcaccgaacaacagaagcatggtgttggtttccactgctcataagcccaccattgatttgcctgcctccaacaaggtgagcagcaatacctgagaatccgcgatctggctgcctgaaattgacatcactgttggagacactggtggtgtcagagcgggttgtatttgaggcactggattgaccagttcttgattggaagctttcaagttcggatgcattattctttgggtgcaagtggatggtatctaggacattacactggccatgagaggaagtgggatcagatcgttggagcttttttgtgctgagaaagcgtccaccagatcctcgaaccctatttaaggcatgaatgtgccgagactcatgaaggtatggctttcgatttttcacaagtttgttttgagcctcaagttttgcccgtgattgtctccttctcagaattccatggtactgtttagcattaacataaatgggtccatcatctgcaagatcaagaggtagtgggactcgtccagcagtcatccccaccatatgagaacccatctggggctgaataaatgcatgtggtccatatggattaaacagcccaccaaagtaaggatcagcacatggatatggagtacgaaccattgaatagctacaatcagcttgcgaatgattggacacaccatc

SEQ ID NO: 17599 - DNA, 914 bp, Populus trichocarpa
  Predicted polypeptide sequence is orthologous to G928, G931
ggtgtgggtgtggtggtctggagagtttcaagagagggagacatgtccaacttcttccctacagcctcctcttgaaattctttgcttcttcttcaactactacttattgacttccttatcagatcccaaggatgaaagttgtgggaagggcgtgaagggaaaaatgaagccagttctcttgttgagtactccagatagcgtgtctaatcactcacaagctgattgtagctattcaatggttcgtgctccatatgctgatccttactttggtgggctgtgtaatccatatgaacttcatgcttttattcagccccatctgggttctcatatggtggggatgacagctggacgagtcccactccctgttgatcttgcagatgatggaccaatttatgttaatgctaaacagtaccgtggaattatcagaaggagacaatcacgggcaaagcttgaggctcaaaacaaactggtaaaaaatcgaaagccataccttcacgagtctcggcacattcatgccttgaatagggttcgaggatctggtggacgctttctcagcaaaaaaaagctccaggaatctgatcccactcctagtcagtgtaatgtcacagataccatccactcacacgtaaagaatgatgcatcagaactagaaagctatcagtctggaaccggacaatctggtgcctcaaatactacctgctctgacatcaccagtgtctcctacagcaatgtcacttttaggcagccagaacgccggttctcaggtattgctactcaccttggtggaggcatggaaatcaacagtaggcttatttgcagaggaacccaacaccacacttccgttgtttcagtgaaatatggaagaagaccgtgtaatcggtcaggcaattcatccttggcttcgtctcttttac

SEQ ID NO: 17600 - DNA, 782 bp, Populus trichocarpa
  Predicted polypeptide sequence is orthologous to G928, G931
ttttttttttttttttttcttttttttttttttttttttttttttttttttttttttttttttttttttgacatgcccgaggatgtttaaacaaaaaaaaaaaaaagcaaaccccagaaagatcaaatacataacaggggccgtcggggacattttgtttttagtaaaaaaaaccaagccaaggatgaattgcctgaccgattacccgggcttcttccatattttccctgaacaacggaaggggggggttgggttcctctgcaaataagcctactgttgatttccatgcctcccccaaggggagtagcaatacctgaaaaccggggttttgggtgcctaaaagtgacattggtgtaggaaacactggggatgtcagagcagggagtatttgaggcaccaaattgtccggttccagactgatagctttctagttctgatgcatcattttttacgggggaggggatgggatctgggacattaccctgactaggagggggatcagattcctggagcttttttttgctgaaaaagcgtcccccaaatcctcgaaccctatttaagggatgaatgtgcccagactcgtgaaggtatggctttcgattttttaccagtttgttttgagcctcaagctttgcccgggattgtctccttctgataattccacgggactgtttagcattaacataaattgggccatcatctgcaaaatcaacagggagggggactcgtccagctgtcctcccccccatatgagaaccccaatgggggtgaataaaagcatg

SEQ ID NO: 17601 - DNA, 900 bp, Populus trichocarpa
  Predicted polypeptide sequence is orthologous to G937
gatcatcatccctctactgattacttgtttgatgcaaaacaaagcttcaaattagaatctaagacaaacaagaaagcaaatcagtatgtgaatgaggatgcattccaggcttgtaaaggcaggactgcagcaagaacatttatgccatttaaagcctaccctggttcgtcaaggaaagaggatgacagtaatagagaggaattgccggttcctgctctttctcttttaactcctggaattaagagcataaaagaggaatccaactctacaggttcaagaagcagttgtagtagatcagtttctactactgccccgaattcagaatcaaatttacgaaatggacctcaatcccagcagcagagttctaggaagcataggaggtgctggtcaccagagttgcaccgccagtttgtcaatgctttacagcaacttggaggcgctcaagttgctactcccaagcagattagagaacttatgcaagttgatggcttgaccaatgatgaagtgaagagtcatttgcaaaaataccgacttcatacacggagagtgccaccagctacagcctccgcccctgcaaaccaatctgctattgttttggggggtttgtggatggcccaagatcagtatggtgactcctcaaaggctaacagttccaagtctggctctccccaaggtcctctgcagctagctgtaaacacaggagggacctccactacaggaggtgatagcatggaggatgacgaagatgcaaaatctgagggctatagctggaaaagtcacattcacagatcaggaaaagatgtatagagtttgtccaccatgaattttgcagataaactatacatgataggattatataattatagaaataatactagaaaaatcacataatttaaaggg

SEQ ID NO: 17602 - DNA, 933 bp, Populus trichocarpa
  Predicted polypeptide sequence is orthologous to G938
gacatgttgagacaaacatgagtttcattcagaaaaggaagcagcctgctggtgagccacatatgatggttgatcaaaagatgtataggtgcgagtatcctcaatgcccctacaatgattccagatttgggtttctcgacgtcactgcaagaaataatcaccaaatgaattgctcataccgcactaacacttctcagggatttggaatgtctaatttccaaattaacagtgacaaaccagctgtgttttctctcccatttccccaaactaaggcagcagctccaaaccagaccccttcatttaacgtttcaggacttggacttccagaagatgggaaaaaaatcgatttctgatcttatgtctttctatgataccaatcttcagcgagacaagaacatgaatcctgggagtgccaatgttatcggagatcaaaatcagcagcaactgcaagagcagaaatttcaattccatctggaccgcaggaatgtcaattttatgggggaccaaaatctgcagcagcaacagcaacaacagaaatttcagtttcagctggattctaggaatgctaatgttattggtggtcaaaatcaacagcaacagcagaaattccaatttcagcttgatgatagcttctatggccaaggggctataatgggaaacaacataactgaagtgaccagcatgccagtgaacagttctgctttcccatcaactgaaatgcagtttgatcactgcaaggcatttgattctgcatttgatgccaatgtcaatgataatgttgctgacttcagatttggctctccgttcaccatgccaccagttgactattccatggatccaatgccaaagcaggatgctggcatgtggtacgtctaacactctgggaagaaagtcatcatcaacacagagcctgcttcatagttgtgaaacttc

SEQ ID NO: 17603 - DNA, 896 bp, Populus trichocarpa
  Predicted polypeptide sequence is orthologous to G938
ttttttttttttttttttgagtgttttgcacaaactttattagcacgaacggtacctgctagctatctaaattctacccctaaaaagagagtaaataataaaatacaaggacggccatatcagtttctaggcagtgagagtttgccctggatgtaatgcaagattagaaaagctcttccagtccaaggagatagttttggtaatgatattagaaccaggttgaaacatcctgatgctttggcagagtatccattcccagtacttgtagatcatctttgtagtcgaaagaggacaaatcaaagggggagccgaacatcaagttgaagccgctgttgttttggttggtctcgaacggagaattcaagggtttgaacctgtcaaactgaccaccttcctgggaaaacatttgatggttttggttgatgttggacccttcgaagatacttccgttaatcatattgctttgacttcggaagtggttgtcctgctggtgttggatttttggctggaaaacattgtgaccttctgtgaccaaattgttaccacgatttgtgttcttgttgccttgaatattagtgtcatagattgacataagctcactgatcatcttttgcccatcttcaggaactcctgatagattgaaggaagagggtgctgggttcaccaatggagcagttgtcttggactgtgcagatggttgaggatagatgacaggcttgacttcattaacatgaaaatttgaccctctaaactccaatgaagtgcttctgtatggacaatttagttgatgattgtccctagaagccctgtcggggaaacccaatcggatttgactatgagcacattgaacagcctcgcatgtgtagatcttctgatccaccatcatgtttatatca

SEQ ID NO: 17604 - DNA, 922 bp, Populus trichocarpa
  Predicted polypeptide sequence is orthologous to G938
ttttttttttttttttttatatctaacttatttgtttggcagtcatatcttatacctcatatgaaatcaagagcaggttaatttatgggaattttacacaaattttattatagcccatatgatacctgccaagctatctaggattctacaactaacaactgcgaaaataatacaatgaagtacacactagcttcttgccagtgagagtttacactggatttgtaacgcaagatcagaaaagctcttcaactccgaggagagagttctggtattgttattagaaccagattgaaacatcctgctgatgctttggcagagaatccattcccagtccttgtagatcctctttgtactcgaaagaggacaaatcgaggggggagctgaacatcaagttgaagctgctgttgttttggctggtctcaaatggagaattcaaaggcttaaacctgtcaaactgaccgccttcctgcgaaaacaattgatggttagagttgatgttggactctttgaagacatttccatcgatcacattgccttgacttcggaagtgattgccctgttggtgttggatttttggctggaagacattgtgattgtcctgttgatgttggattttcggctggaaaacatggtgacctcctgtaaccagattgttaacaggatttgtgttcttgttgccttggatattagtgtcgtagattgacatgagctcgctgatcatcttttgaccatcttctggaactcctgataaatcaaaggaagggggggcagggttcaccaagggagcagctggcttggattgtacagatggctgaggaaagatgacaggcttgacttcattaatgtgaaaatttgatcgtccaaattctaaataagtgcttctgaaggggcagttcagttgatgatttgtccctagaaccct

SEQ ID NO: 17605 - DNA, 755 bp, Populus trichocarpa
  misc_feature (656)..(656): n is a, c, g, or t
  Predicted polypeptide sequence is orthologous to G956
ttttttttttttttttagtaacagaaattgtgactgtacaatacagtttcaaaatacacatttttgtaacagcttctatactcacaaggtcgctcaaatcaggctcatggtattgcaaaaccttaacttgcatgaacattgagtaagcggttatgtacttggactctactgtacatttgcaagaaccaaatgtttgacctgagaaaaactaataaacctttccaatgttctacaacaggaagagaaagcggaaccttgaatcaaagggtaggatagagaagcttcgggcaccaaggagtctccacttgtggtttgataaacgatctctaaccacaacagcttgctccggggttaggaattggcagatccagtcaggcagtagcaagtcctctacattgcctttggcaaaacaatacagcaactttggcaccaatagtttactcttattgcttataccaacagatgcttggacataatccttcaacgaattctgaagcaactcattcacattctcaggcctgaagatccgcactgcaggtgatgaatgcatcccacaacttaatgcgaaagctaggagaggctcaggttgatcaatggaaaacttcttctgctcctcagttatcttaaatttctgaagtgcaagaaccaaggctatnttgtgggcgaatgtgctgggggtttcatcttcagaatgttgtattcaatgtcagcagcactgatggaatgccctccgattatgtaagcagccttctgca

SEQ ID NO: 17606 - DNA, 800 bp, Populus trichocarpa
  Predicted polypeptide sequence is orthologous to G956
ttttttttttttttttttgtcaagaaaggtcgcgtcattaacaagggggtgcaacctaattatgttagcaacatttggaacctaacattaatcctgtattgaattcccagatacaggcagattttaggtgcggttagtattaacatcatcatcaacgtgaagttttgtcgggcaggaaaaggtaacggaaacgagaatcgaagggaagaatgccacaattacgtgagccaagaaggctttgtcgcctttgtgaaatgcattgctctacaaaggcagcctgattgggtggaaggtaatgtgatatccatactgccaaattcgtatcgtccacaaagcctttagcaaaacaatggagcattttcggcaccaacagcttccctttgttgctaactccagctgaagctcgaatgaaatcatgttgagcttcttgaagttcttctctcacattcttagcagtgaacacccttactgctggtgacgagtacattccacagcttagggcaaatgctacaagaggttcatgtgcatcaatcacagacttctgctgttcctctgatagcctcaacttgtgaagtgcaagaagtaaagcaatttgtggcctgtggagaggtggtttcatcttcaaaatcacatactcaatggcagctgcactaaaataatgtcctccaatagtgtatgcggccttttgcatcaacgagaagagcttcaagtcactccttgggactccatatgccaagtacgcatgcataatcaaagcattgtacagattgatccagaaagcaagcttctcattggagctc

SEQ ID NO: 17607 - DNA, 506 bp, Populus trichocarpa
  Predicted polypeptide sequence is orthologous to G962
ggttttggatgagatgtggatactaaccctatcacttagggtagtatattcaagaaggggtttagaatccattgaaggaattgcttcatcattacagatttcctatgccagatataagacattttgctccagtagaatagcaatgagatcaatgtgtcagatgatggcaagttcgaatataaaatctttgagaattgattgcttcacctgactttgtgatctcgccgtttttctattgatggcagggtgtttctttgcatctatgagaaaatgttaatttccctattttgccagctttactctggcaattagacttgtttcagcttatgttctgttttctagcatcttaaaacatattgtaaattagtctcctctcctctctctaggacctctaagcttaccctgtcatgtattccatttctgaactctattgtagcatatttggatggctttcttatgaatgtgaattctaaataaatctttttatgaaaaaaaaaaaaaaaaaa

SEQ ID NO: 17608 - DNA, 936 bp, Populus trichocarpa
  Predicted polypeptide sequence is orthologous to G975, G1387, G2583
ttttttttttttttttccttgcaaatcaggcaaactggttttataaacactccacaagttatatatatctaggcttgtggcccctaatcaacacaacttgcattgagaaattgtgtagggttcaaagcaagtgattattggtttgtacaatatttccacagtcaccaatcacaagaacaaataagttccttaaaccatggagattatgaggtgggattctgtgattggcaactatacatggaggaattggacaacttatataggaagggaatggagaagggattcttatactagctagctgccatgtaggacatgcatggaacaagggtcaaggaaggtttaatgtctaaaccccacaagaaatagaggtaaattaatgtcatcaattccgattgagcagctcttctatcatttgcatagcaattctatcctcttcttccgtaccattttccggctcaatctcaaccgtcggcgatgactctgtcttcttgttgtaatttccaagctccaccttcatgacccaatttgaacttgaacgagaaccagctttcttctgccacacaccaatatgagagttatcattatcaagcctcaggcaagtgagtgaaggagaagggtctttgccgcaacactttcttagctttgagttgagaagctcagccagtgccttggcaggcaagggagagttgttatctttgccaagatttgtgtcttgatcaaggtgacttgtcgggaaattggtcttggcattctgtccattcatcaatatagctgcttgatcatacgctcttgctgctgcctcagctgtctcaaatgtccccagccacaccctcctcttcagtaatgggtggcgaatttcagacacccaagagccccactggcgttgcctgacgcctctgaatttctttgattgtaccatgtttcgggagaggcaat

SEQ ID NO: 17609 - DNA, 699 bp, Populus trichocarpa
  Predicted polypeptide sequence is orthologous to G977
ttttttttttatctccactcacactactttagattatgtatatgattagattgggaaaaataatcaagaaggtgattaattaagtagaattagcaaatagaaactgctgctgctgcattttgatgtttctttaatttcagcagaactctcatgttgaatctacataacagaactccatggatcctctatctagcaactcctctatcatttgctctatatggtgatcttcaagtgacttaaaatgttcttgatggtcatcgttccccgcttgactcccccccccaacccaattcccctcctgccatttcgagccgttttcgacagtttttccggcaatgccatggctagtgccaaaactggtgcattgtgcatcatgtgactgttttgttacatttttcttggttgcttgtagagaagtcatgtgacatttatgtagcttggctgccaaggtagctgagagaagctttgacgatgatgattggggttcgttggggttgtgagggaaatttgtacgtgcttttggcccgcacattagccttgccgcctcgtcgtatgcccgtgccgcgtcctcggccgtttcgaatgtgcctaaccatattctagtcttcaggagaggatggcgaatttctgaaacccaagaaccccagtgcctttgacggacgccacgatatcgctgttgtggtctagtcatggtgcttg

SEQ ID NO: 17610 - DNA, 761 bp, Populus trichocarpa
  Predicted polypeptide sequence is orthologous to G979, G2106, G2131
ttttttttttttttttttggtcctttgaacgtagccatttgacgtagcggcttaggtcaaagcttgtcacagcattaagtccacggtactctatagctgccatgtcatatgctgttgctgcttcttcttgagtggcatatgttccaaggtagaggtacttgttgccgaaaactctgccaattcgagcttcccatcttccattatgatggtgtctggctacacctctatatttggacacaccgcgtgaaaacccactactttttctcctcagtgatccaatatattcttctttcgaatgaccctccatctctttgaattcttcttcgtaagttgacagaggaaaattgaggatagtatcctgtccccagtactttaatgctgccaagtcataggcatgcccagccgcttcttcgtcatcgtaggcccctaaatacacttgtcttcctttcttgttctgtgactcattccagcagttcttatcccacaaatgagcctcataacgtccggtccatcgatgccttgtaacgcctctatagatggagctgcgttgaggaggagagtctcgaggaacactctttctagtccgcttcaccttggttgcgggattaatgctagtgtttgcagagttctttaggctttgcttcgatgtttttcccatctaacttcaccaaaagaaatgcacaaacacacacacacgtaaaaaaagtgttgggaggcagattttgagagagggagagggagagagagagagaggaggggga

SEQ ID NO: 17611 - DNA, 925 bp, Populus trichocarpa
  Predicted polypeptide sequence is orthologous to G987
ttttttttttttttttttataaattgatgaatattactgctacttgaacaacgggcatctaatagaattgtggtgagcagcagccaaaactctactcccactatccctgctcagcaaatacataataacatcatcaatttcttttcaagttcacttccattccagagtaaacaaatggcaaggtgatgaaaagaaaaatgagacttatttttaatgggaaaatgtcagtaccttaaattctgagcagaaatctacaacaaagttgatatagcacaagggcaccatgtcagccacatggagaatcctgtcacccttccgatccacaaataaaactcaaaacgcatttaacaatcaggcttccaagaagagagtgcataaacaatccggcccttccacccttggagcaaccactggctatcttcatcaattacaaaatccttgtggtagagagcttccaccctctccttcgctgtcgtaaaaatctcccgattcaaagggagctgcctaaacccagcccttaggacccgcatctgccactgcttgtatgtctctggcctctctatcctctctggaacctcacgagacacattagcctccagaacatcaaacaaagtggagaagtggaacagggcctctcggaagcgtgtgataaagaatggagcattgtaggctccattaactaccccttgtatgaaaacatcaggattcatattcctgatcaaattgagaacgatatttctaggactctccaccaccacagtctcatcaagcaagtttcttaatctatacccagaattcacgacaagcacctcatttctatcaatcttgagatcctcaattttaatggtttcccacttctgtgctatagcattgaacttgaatggaactttgaaagtgtttgcataatttgctaagcggcgtcctg

SEQ ID NO: 17612 - DNA, 767 bp, Populus trichocarpa
  Predicted polypeptide sequence is orthologous to G987
ttttttttttttttttttgcctttccacttccaatgattcattgcatattgagaaaagctgaaccaagatcaacttatatataagaacatggtctcagaacccctttgatcaccactccaagatggaaaatcatctagacaaaaactacatgacttgattacaagatttcccgacaaaaactacttgacttgattacaagatttcccaacaaaaactagtttccagtagtgtaattacatcctttaagcataagagggcttcacgcttgttccaaaagctcactgaaagaagcacattcactcctgtagttccacaccggcttttgagaagtgatgcttcagaccaagatgaacaagccaccaaccatcgaattttttataatattatataaaaggatggtgatggtgatggttcagtagttaccaactgcaagtctaaaactccataaggttcctctcgggctaggtagcatcatagatcatctttgcctgatttgaaattattcgttcctgtccagctctttaaaaaacttatagctctccgttccaagttcaaatgctgtccaagactcctatgcaggcacccaacaagaggaagcataaataattcgacccttccaaccctgcagcatccagtcgttgtcttcatcaattacaaaatccttgtggtaataggtcttcaacttacccctaaactttgtcatgagcttctgttccaatggtagagtcttgaaccctgccctcacagtccgggcctgccattgctt

SEQ ID NO: 17613 - DNA, 785 bp, Populus trichocarpa
  Predicted polypeptide sequence is orthologous to G1017, G2567
ttttttttttttttttttgcacacagacaaatccagcatatcctcgcaagctaaaacaaatacaagacaacgaaatttcatgccggaattgaatggcatcggtgatgaacataaaagtcatttcattggaaagttaaatcatatcccaaaagtggatggagtggacttatcccacaactcccgatagacaaaatacgtgaaaagttgcaatcaaaacaaatgacttgctaactgtacaattcgatggaagttcctcattgtctaccttccgaagttgtctctacttgcatatgaaagaattgttaaccttcttgctgtcttcaaaaactcactaaagggctcatctccagcatgtttggtggcgccagctgcatcccggtaaagcacattgctcagcatctctgaactctcaatgccaaacatactagccaactttctgtgcagctcttcgtatgaaccaaggactgataggtcaagggttcgaccaatatcctctgattccaagaacaccttgcaatgatcagtctccaggccaagatcagttttttggtgatccttgtaccaagtagacctctcatctgaagaattttccatcgggccattctgttgtaatgcagaaccagacccatcagagctggccttccctagatttccatctgatgaactgtttgcatttgtatcaccagagcagctttgagaactctgctgatcggtaacaataagctgaccaaacagtacaaagtggggtgtctttgtttcactgctttccttcaaactctgtgagg

SEQ ID NO: 17614 - DNA, 922 bp, Populus trichocarpa
  Predicted polypeptide sequence is orthologous to G1020
ttttttttttttttttttctgggagaaattaaggttataatctattgattaaagagttcaataaaaagagtgatacagtgtttttcaacaaacaacagtaaagaaacagagtttccctcactgttgctaaaaaagagatctgccaaaacgtattcacatacgttaaaaagaaaaagaaaaaactaacagatcacataattaacctctctcactttttttgtgggtctttttctaatcttttctaatataaaaataaaaaaaaggccaaaattttttctaaaaaatcatgcaatctccggtgggggaggaaggttaagatcaagatcaacagatcttctcggagtcttgacatcttgatgattcaaatcaacgacagaggatgaatcagaatcactcaagaccccaccgcaagaaaaaatcaccggctggttaggatgatgatgatacccatgatcgaaaaccatccttcggtattgactcttcatcaatgcatcaaaataaaccacctgctgatgattcatcgccatcggctgaaacggcaatctaacggtggatacagcgggaccaagattaagatccaacggtgcatcactgctacaaaactccacggtactactttgactgggactctgattattaccaccaccaccaccaccaccactgttattcttgctggcagctttcttgttgctgtcgatagagagaacgtttttcttaacgttctcgcatgatggatatggaaagttagtctttgccttagagccacggaactcacgtgcggcagtatcgtaggcacgtgcagcttcctccgccgtgtcgaaagtgccaagccaaacccggctcttcttactcgggtctcttatctcggcagcgtaccttccccacggcctctttctcactcctctaaaatgcacttccttgc

SEQ ID NO: 17615 - DNA, 926 bp, Populus trichocarpa
  Predicted polypeptide sequence is orthologous to G1020
caaaccccccgaaaaataaaaataggaaacccccaacgctaaaatggctcctagagaaagatctaacaacaacaacagccccaacagccctagatcggagatccgttttagaggcgtcaggaagagatcatggggacgttatgcagctgagatcagagacccaggcaagaaaacgagggtttggctgggcacttttgatactgctgaagaggccgcccgtgcatacgatgcggctgctcgtgaattccgcggagccaaagccaaaactaatttccctacaatcggcgagcttaatcccaaccccacgcgcagtcctagccaaagcagcactgtcgagtcctcctccccaccgcccccacgcgccgcttctcctccaccaccactcgacctcactcttaacatttcccgccataaacccgaccgccagccttttcccaatggagttagttttccaggaggcgcgtggtttccattccctgctgttgcgcgtcccgttttcttcttcgacgcgtttgctcacgcgaagaatgatattcctaacaataatagtatagtgaataatattaacatgtgcaggtttgatcgaacggtgatggtgaatggaggtggggcccagagtgattcggattcatcatcagtcgtagattacgatcgtcgtcgtgatagtaagggattgtcacttgatcttgatcttaacctggccccaccaccggaagtctcatgatcttgtggtttttcatggagagatctgattttggaagtcgttttatggcttcagtgttgtttttttcctctaatttcctgggtacgacaggaagagagcaagttttagagaattagagctaattaaggaaaaaagaagaaaagaaaagcagctgacgtattttgtatatagagagaacggaaattatctaaaactatttccc

SEQ ID NO: 17616 - DNA, 689 bp, Populus trichocarpa
  Predicted polypeptide sequence is orthologous to G1033
cacgtaaaaatatcctccccccttctctcctcctctttctctctctttcaaaccctatctcagctcacctaccggattcgcaatgaaaggaggtagatcaaagtcagatactaagagcgccaagctctctgtgaccaagaaaccaaccaaaggaggaggaggaggaggagctgcagcccggaaatcaggaaaggcagctaaggatccaaacaagcccaagaggcctgccagtgcattcttcgtcttcatggaggagttcagagagcagtacaagagggaacaccctaaaaacaaatccgttgcagctgttggaaaagctggaggagataaatggaagtcactgtcagaggctgagaaagcaccctttgttgccaaagcggacaagaggaaggttgaatatgagaagaagatgaaagcttacaacaaggagcaggctgaagggcccaaggaagaagaggagtctgagaagtcaatgtcagaggtcaatgatgacgatgaagatgatgaagagggaagtggggaggaagatgacgacgacgagtaggatatggagccggagaatagcttagtcatgtaggttgtgacaatgtttggacatttgatgctaatgactggctattttggttgttaattttttgtctttcagttatctttttaagggaaggatatgcgtactgctccctttgtta

SEQ ID NO: 17617 - DNA, 813 bp, Populus trichocarpa
  Predicted polypeptide sequence is orthologous to G1033
ttttttttttttttttttacagaatataaccacttatctaattcattaaactttggttcaagtaaacatagagttctcccttctacacctattaacttttatccctaggaaggaggaggacaaaataacaaagggagcagttcgcatatccttcccttagaagacagtaattgaaaaaaaaattaacatgccaatactcggccattaacatacaatgtccaaacattgtcaccacctacatgactatgctattccccatgtccaaatcctactcgtcgtcgtcatcctcctctgcactgccctcctcgtcatcttcatcttcatcattgacttccgacactgacttctcggattcctcttcttccttgggcccttcagcctgctccttgttgtaggccttcatcttcttctcatactcgactttccttttatcagccttggcaacatagggtgctttctcagccgctgacagtgacttccatttatctcctccagcttttccaacagcagcaactgatttgtttttagggtgttccttcttgtactgctctctaaactcctccatgaagacgaaaaatgcgctcgcaggcctcttaggcttgtttggatccttagctgcctttcctgatttctttgctgctgctgctgctgctcctttggttggtttcttgttcacagagagcttagcgctcttggtatctgactttgatctacctcctttcatggagaaaccggtgtggggggttagggtttgaaagagagaggaagagtggaggaaaggaaaggtctatgtcttgcccaagcaccttgatg

SEQ ID NO: 17618 - DNA, 811 bp, Populus trichocarpa
  Predicted polypeptide sequence is orthologous to G1033
gaaaaccccttcccctatccctctctttaagccacacacaaacccgcacccaaaattaccaaatctcctcatctcctcaaacaaaccctagaaactctctctccaagaaatcatcatgaaaggcggtagatcaaagtctgattccagaaacaatgacgccaagctaaagagaaaaggagcaggagctggaaccaaagcgtcgaagaaggccgcgaaggatccaaacaagcctaaaagacctgctagtgctttcttcgttttcatggaggattttaggaagcagtataaggagtctcatccaaacaataaatctgttgctgctgttggtaaagcaggtggagacaagtggaaatccttgagtgaagctgagaaagctccttttgcggcaaaggctgagaagagaaagtttgaatacaataaggacatggctgcttacaacaaaagactggctggaggaaatgatgatgaatctgacaagtccaagtcggaagtgaatgatgaagatgaggaagatgagagtgacggagaggaggaagatgatgacgagtaagttgatgacgaggagcggctgaggatgcgaggatgaagtgatgggcaatttggtgtggaattgcttagattgctgtaatcacttgcatttctagcttttaaatattagctccctttttagctgttgtttagatctagcctaggataaaaccaaaggaatagtttcaggagcagcagccctggagctcatatggtggtatgtacttatcaaatattttcatgctcaatgaagtgatttcttccccaaaaaaaaaaaaaaaaa

SEQ ID NO: 17619 - DNA, 857 bp, Populus trichocarpa
  Predicted polypeptide sequence is orthologous to G1037
ttttttttttttttttttggcgatgacaaaacaactgcaattaacatacagttctctaaagaaaattagaagtggaatacatagatatattgagtatcaattacactaggaataactcatctgcaagaaagcacaaagcttctgcagatcatcctctttagagaccttggcagcttaaatctgctttatatgcaattccttagagaataaccacaacatccgaagtctccttctggtagcttcacctgtcttgttcctgattgatcattacgctcaccaaatcttccaaggagccaaaattattcgaaacagaactgtcctgtggcttctcttggcctagcaaatacccatcttttgacctcactaatgtttccatggctgaacattcaacctcattatgcttcatcaatgaggtatcaacaaaatttgacggtccagttgaaatgaagcttgtggttctctgaaaaaacaggttatttggatctaaattgaacccattgggactcccattaccattaataggaaatgctgagtttattgagttagataggccatttgagtggtaaggatcatcctgcctatggtcatcccaccctagagagccattattaattagctgtccagcattactactcactgtagccactcccactcggcatggtagatctgctttggagtcctgtaaatgtatgggaagagttgagacagaagaaacatcacaaggattattcctgctttgcaaggccattgttgacatgcggtctctgatggcactaggatgcagagtagattgcttaaaatagtcattcaacgtaaaagaatctgactgggccccatttgacggaacagcgttggac

SEQ ID NO: 17620 - DNA, 845 bp, Populus trichocarpa
  Predicted polypeptide sequence is orthologous to G1037
ttttttttttttttttttaagcctttggtcaggtactgcttcactacttccttgattaggcttgtctcggttatccgagctgtttctgtctttgttatcacttttctttctcctaatcacatgttgccagatggtctttagctcctcaattcgaacaggcttgagcaaataataacaagctccatgagtgatccccttcatcacaagctttggatcaccgtttgctgacaacatgatgacaggtaggtccatctcaagccccaccagctccagcaatttaaaaccatccatgtctggcatatggacatcactgataaccaggtcaaacttgttcttgttttctctcaacatcctcaatgccgtgattgcctgactcgtcgtagtaacattgtactggcatcttcggagtagagtctctaacagtaaaagacaagttgggtcatcatcaacagccaaaactctcataccaataggaaactgatctatattgctatctccaatcccctgttctacagtcattttttcctcttcaaaacaatttgacgaagcaaaatatgaaagaaagagactaatttacagagtggggttctacaatttgcttcaaagtttggagctttaactggattttgtttcaaagtttggagcttttaacaaaaacctagaaaccataataattgcagagcttgaaaatttgtcagttgagagagagtgacaacaaaacctcgtgccgaattcggcacgaggaatggagcaggtttcatatggggagacaaccactgatcatagttgctgacccagagctttgtaaagaagttgcgataaagaagttcaaagacattccaaat

SEQ ID NO: 17621 - DNA, 782 bp, Populus trichocarpa
  Predicted polypeptide sequence is orthologous to G1043
ttttttttttttttttttacttcacctcgattatttccttaattttcaagcaaattaagtacacagtccaaaagcaaaaaaagaaagagaaaacatcgacctttctagtttctacattgtgctaacctagctacctagctaggcagcttctaacacttgtcaaagaaaataaccaggacattcttgattactaggcggaaattacaaagaagctgcaatatctaatgtcgtgaaaataattatctatcaaggttaaaatccgaaaacaccatcatcatcgaaatcagcagattccatcatgataccatccatgtccagactgtgtgagctcgtagtgcaagatgagttgaccccagaaatcacatcgccgtgatcaaatgcagacatataatcatcaggtgacaagagataatcagaggatgatgcttgattattatactgggtggttggatcataactaattggtatgttcatgtcatcctccttgtggcaacattcttgttttactgtttggaaggatgtgaggagggagttgcttggcttgttcgaagcgtgatcaccattgctgttaaagcttatcagtatggaggaatctatatcgtggtgatcacttggatccaagacaaattgagaagcttttagcaaattcttgcacgtgtgatgcccataatatgttgtacggtatagaggaggttcttcttgaattctttgcacttgcttgattgcttgacattgttgatcatacttgtgagtgcacctgaagtagttccttggatatttac

SEQ ID NO: 17622 - DNA, 805 bp, Populus trichocarpa
  Predicted polypeptide sequence is orthologous to G1047, G1808
ttttttttttttttttttaacaataggaaaacaagatagataatatagctttaaataaccgaccgagcacgagtcaactactctttttacatgagaatgaaccaaggctcaccaaaaccgccaatcattttgccctaaaagcaccctttaccaaaaatcaccgtaaaccccaccatttaagttttgcttcatagcagctttatcatttacatatatatataagactctacaaggagtgctgatcagaagactctacaaataaagcctcgttttcttcctgttttaactttcagtttcatgatttattgagtttattttatagtttatgaagtgattaatgatggagctatttgttcggtggtggtggtggtaatcatattattgcatggccacgcggacgtcaattcttggagttgcctcatcatcaaaatttggcgtatgtccgacagcttttttcggagcgtactatactcagaccggagtcggtcgtagtctgtccgtacaccatgggaatggtacaaaacaaagcgcaaccggttcgtcagttcccggttctcaatcctaagccggttcacctggttccttaggttttctacgtgcttctgctttcgcatccgtgaccgccttgccgactcccggtttgataccatccgcctgcgtttcctctcatctatgagtgaagcttgagggtttgggtcgtcggagccagagtttgagttcgagttgtcagggttttggcctgcctggttggatttatccgaaccggaactcgaaccaacaggttttggtgactgaggagagcttg

SEQ ID NO: 17623 - DNA, 889 bp, Populus trichocarpa
  Predicted polypeptide sequence is orthologous to G1048
ttttttttttttttttttggtcaaaattcaaatatggatacgataaagagtttctaattgtcaatcagggaacagcattgttctatgtgctcatcgaaacattcaaccagctttgatcactcagctcaacatgataaagagctctagaccttaattacaaaaccaaatttagagaaggaaagattacaccggtaagtttcatccttggccttgaagctttgcatcttctactgtttgccaaggatatgaatattttacttcctgctcctctttgagccacgttttctggtgctttcttttccattgtttctagtagaacttccaccattgttgactggggcattgcaggctgggggaataggcacatgatgcccaggagccaaagcagggaacccaacagcagggattccaacaagagcacagcagactcctgcttggccgaggtaacaccaaatgcattgcccctctgtaaactaaggcgtagagcatggttctccgcgataaaacactgaagcagcctgtccagcctcctgcattccccttccaaatacctactcttaatttcaagatccctaacatgcaacttcttcctttcccttgatctcaccctcgtgccgaattcggcacgaggctagtctcgagttttttttttttttttttgtttaggaatagttaattatttcaaagcccacccgcccaaccgtagaatattgtgaatttaaattttacgcgattttataagttccgtctgttccaatgtctccatcgaatactttcatccgcttgaagctctaaaatttaaaatatttaggccaatttcaatggattgtcaaaagctgatcaaacgttgatcaaagggattatttttggattgatttttctatttatg

SEQ ID NO: 17624 - DNA, 911 bp, Populus trichocarpa
  Predicted polypeptide sequence is orthologous to G1050
ttttttttttttttttttggaataaacaaagaaagagttttcttcaaaacgtctcaacaaaacatattatgcctaagaaatgtttccctttaggaaataaatacctaacagatacaaataacattcataatcataagtaacacatatattgaggcttgtatgtatatatcacttcaaacgaagttccgagctggatatgcgatgcaggttgaatttgtaactgccacaccttaaagacgtctcttggagatggaaaactaatgaatgaatgcattgaaagaaacaaatgtaaagcaccagaagttggtaagacgattaataacccaagcagccatcgatttctccccaacctattgattcgaatctgactttaagatagtactgccattttgttgaggctgtggctgggaggactgctgctgctgttgcaactgatgcatgttgatttgggaggctgaaggctgctgctgctgctgcaattgctgcctgttaagttgggaaggtcgtggctgctgcatgaacatctgagggttgacagaaagctgctgctgaaccaagcccttggatgggtcagaatccccaccctgctctgccatagcaatcttcaaccgtcgtacttcaccgtttaatgcttcgtttagagcatctcggagttgtgcttgttgctccatggcttgaaggcgaaatttcaattcattattctggcttgtaagaccaacagaatccctctgtaaaagagtaagctgagcagacaatgtggtagcttctgtctgcaaagtctgaaccttgtgttctaattctgaaatatatctcatcttcctctccttagaacgagcagctgattgccgattcggcaaaatcctctttgcacgttttgggtcagttgaagcaatctcagcaagtttctcatt

SEQ ID NO: 17625 - DNA, 748 bp, Populus trichocarpa
  Predicted polypeptide sequence is orthologous to G1050
ttttttttttttttttttcttttttttttttttttttttttttttttttttttttttttttttttttttacaacgaaaatcaacccttctttactgaaataaacaaaaaaagagttttcttcaaaacgtcccaacaaaacatattatgcctaaaaaatgtttccctttaggaaataaatacctaacaaaaacaaataacattcataatcataagtaacacatatattggggcttggatgtatatatcacttcaaacaaagttccgagctggatatgcgatgcaggttgaatttgtaactgcccccccttaaaaacgtctcttggaaatggaaaactaatgaatgaaggctttgaaaaaaacaaatgtaaagccccaaaagttggtaaaacaattaataacccaagcagccatcgatttccccccaacctattgattcgaatctgactttaaaaaagtactgccattttgttgaggctggggctgggaggactgctgctgctgttgcaactgatgcatgttgatttgggaaggccggggctgctgcatgaacatctgagggttgacagaaagctgctgctgaaccaagcccttggatgggtcaaaatcccccccctgctctgccgaaacaatcttcaaccgtcgaacttcaccgtttaatgcttcgtttaaagcatcccggagttgggcttgttgctccatggcttgaaggcaaaatttcaattcattattctggcttggaaaaccaac

SEQ ID NO: 17626 - DNA, 626 bp, Populus trichocarpa
  Predicted polypeptide sequence is orthologous to G1050
ttttttttttttttttttgaagaaaatcttctgtttcaaatagactgcttcaatttttatgtaagatcaccgatcccagttgtacaaatataaagagtgatgaatgaacagaaatcatccttttctttaactgtttgcagatctaagcacctcataatgacatatttgtagcaatttctctattgtcagagtaattttaaacacaaccattctcctgatccgaagcagtaagggtttttaaatcaattactaacggaactgttaaagataaataaacaaaataattaaaaagtgggtaattaaacaaaatgatcatagaggtggtggaagaacaaacaaagccaagaaaagaaatgaaacctccttggtttcaacgttccatagcagctaaatctctacgcgccgtcgctttccaccaccggcgtcgcgttcaaatccaaaacaccgttttcctccttctcctccaccacagcccccacctcttcagccccggaactctggatcatattctcctcctcgttatttccaccaccatcaatcacttccaccactttagcctcaactgcagcccgccacccttctccactaccctttccaaagtacttcgcggcttcctgcatcctccc

SEQ ID NO: 17627 - DNA, 826 bp, Populus trichocarpa
  Predicted polypeptide sequence is orthologous to G1050
gcagcaaatgagtacccagaatttcagtatgggacctacccattcgcgatctttatcgcagccatcatcgtttttctgccttgattccttgccaccgttgagtccggccccttttcgtgactcctcttcgccaacggtttcggaccctatttcaactgatgtgtccatggaggataaggatggtagctctcattcgttgttgccaccctccccttttaataggggcaatgctccacgtgttggtgagagtttacctccacggaaagcccatagaaggtctaacagtgatattccatttggtaatgtgttgcaatgttcacctccccttattccgttgaggggttcaggtggcttggagcggtcgttgtccggtaaaaaaagaatgggagagaggtggtgaaagcattgcggaggggacgggtgagaggaaatctgaaggggatgtggatgatttgttttctgcttatatgaatttagataacattgatgcgttgaactcttcgggtactgatgagaagaatggtaatgagaatcgtgaggatttggatagtagagctagtggaactaagacaaatggtggtgatagcagtgataatgaggcagaaagcagcgttaatgaaagtggtggcagcgtgccaagaggaggatttagttcttcaacagagaagagggaggggatcaaaaggagtgctggaggtgatatcgctcctacctccaggcactacagaagtgtgtcaatggatagtttcatgggcaaattgaactttggtgacgagtctccaaaattgccaccttcaccaggaactcgtccaggtcaactttcacc

SEQ ID NO: 17628 - DNA, 929 bp, Populus trichocarpa
  Predicted polypeptide sequence is orthologous to G1062
ttttttttttttttttttagttaatgggtatttttattgaaatgctgaaagcaaggcaggagaatatagaatcttgattctttcaaaaattcaaactgatggtgagtttttctgcatgatacctatcctacagcagcctttagaggcaactagctaataacactattggtgacatagaagaccacttcgattgacagaaagacaacaatggagcaacttttcccgtcaccaggcaactgagcttcataacgtttcttcaagttcaactggttactacatcgcgccatggaagccagctgaatccagtaggactgctttaatttgatctggatgcatgtcctgcccttctttgcattgctcagctcggaagatatccatggcaaaaccattgaaacagctaatgacagcttgctggatgtctagcccaaggttatccaaagctctcatagtggagagcaaaagacctggtttgcggccacaaaacatgtggatgtttacagctcgcccttctctcactctaacctcgacccttgcaggttggccatttgggcttggcaatgagccggggcaaagtttgtccatgatacggctgggcagcgctgatggagtcggtgtcaaaggatgaaaactagtggttggcgtcaatgaagagctggggggagttgactccaattcattatggaggtcattaatcctttgcagaagttctttcaagtaatcaattgcatccccaaggattgatgccctatccattttgctgatctttggaacaacagacctcagcatgtacagcctatcattgagcttcttccggcgcctcctctctgccatcaaattcttagctggaagcccccttttcttccccttttgatccacaccaccaccagtaacaccactattcgcctttgaactgtttccaccattcttgc

SEQ ID NO: 17629 - DNA, 798 bp, Populus trichocarpa
  Predicted polypeptide sequence is orthologous to G1064
ttttttttttttttttttaaggaaaacaaaactccaatatttcaagaacaatcaaacctcacgtgtgctacacataaaaactacacaagtggagggttgatgatcatgatgatgctttttttccatctctatgagtgatgacttgttgtatcatgccgatcatcgcttcctccaccaccgccaccatgatgtgagtgagacccgctcgcctgtgattccgatatgccggatgcccggtaggggtttaatccagctagcatattcaaatgacctaattcactcatcccactattaccagcactagacccaccaatacttgtagaccccagttgctggctaggcaataaggtaacaggagcaggaaaattcataaaatgtaacccactagacatggtgctcctgtacaaaccactgttattaacagaaggaaatgtccatataggatctccgctcatgacttgattattattggaattagccagcatccaaaaatttgctggaatttgtccatgactagctggaactgccccactactggattgcaacaggtagcttcccatctgatgctgttgcgatgatgataaatcttgctcgggccttcttttcctgttgaaactctcttctgtctccgttgataactccagtgaagaattgtctcgcaattcttgctttgcttgcatcattgcgttcagattgttactagattggaacttaaaatgtcggtggtgtgaggtctttacccaatctcagaaacaaactgcgactacgttgttgcagtgaaagattgggctaaactcc

SEQ ID NO: 17630 - DNA, 422 bp, Populus trichocarpa
  Predicted polypeptide sequence is orthologous to G1064
ttttttttttttttttttgctgttgttgtcgttgtctggttcggtagtggagatgggaagagaagggtaaggagaagaggacgaacaaggctcgtcttctttcttttccagtaattggaatgggaagtttgggcggtgtttgtggtggtagtggtggagctgatcatcacctccttccatgatagcatgaaaattaatatgtgggaatttctccaaaggcttttttccttctttctttctgtttatattttctatgagaaaaagactgaatatttactggagtagaggataggatactgtgtcgagggggagagagagagagagagaccctttttctggtttctcgtttctcttttgggtgcctggaattccctcccttgagaattgatgttagagagaggataagggaggaagagctggac

SEQ ID NO: 17631 - DNA, 831 bp, Populus trichocarpa
  Predicted polypeptide sequence is orthologous to G1064
ttttttttttttttttttcgaaaaacctcagaaagaatctattagtgttgacaatgtggtaggaaaagagagaacagtctacattacaaccaacaaggaaacaatggtccactccagtctacaaatctagagcagtcaacacacttgttattggattctaacaagtactacaaataatttacagctgcttcttcctttccagttccaagttctagccccgcaagagaagcaggaaaaagaaggctgacttgtgttttaattaattaaacacaaaaacaataggcctccccaccctaaaaccataagccttacttgacgttagtagtagtacataaccctatccattgctactacctgtgtgtgttttgatgctaattagccgtgactttgcacccattctacatcttatgctccccagttaactcctgctgacgaccctcctccgcatccactgccacagtcgccgccatcggctgcagcaacaaagcagtaaacggcatgtgcctgtaatccaagtcaagccggctgctgggtgccgtcaacagagagaacatctcgggccctatacagttgacggggtggaccttgcaggaagcagaaggagaaggagaagaggaggaaatcggggtggacccgacggtggtggagatggggatggagggggatagtgccggttccggtggaagcgatgatggatgcctcagcgtggcgaaggagccactcgatggtctcgccatcggagcggtggccgagctcacgggtgagctggaagatacgggccgctgttaaagcgggcatccgaacccgcctgccacggccatggactttggt

SEQ ID NO: 17632 - DNA, 349 bp, Populus trichocarpa
  Predicted polypeptide sequence is orthologous to G1068
ttttttttttttttttttgagagagagagttgcaacaatagattgatgcctatgaaaatgctacaggtcattcttgaggatattttaccatgatcaattgcaaagtaaaaacagttatctcatatatacaacaatactctgaactgcacctggataatacagcccagattgtgggtgattaaaaggttagtagttgagcaggaccaagacctggcggggcaggctgtgtaggagcgtcatcactttctctatttccaccggcgctccatcctgcacccccacccctcccctctgaaaaaccgcccctacaaacagctcccttttccatcaaaggcaagagcgtggtagc

SEQ ID NO: 17633 - DNA, 916 bp, Populus trichocarpa
  Predicted polypeptide sequence is orthologous to G1078
gctcttacaaagaattcaggcgccaccacctgatacgcgccacccacctacatacgcgccaccgctagtattctctacttagctatataaacttcaccattagtattctttatataacacttcctcttgtttctgaacatgggctgcacggcgtcgaagctagacaacgaggacacagtacggcggtgcaaggagcgccgccgcctaatgaaagaagcagtctacgcccgccaccacttagctgctgcacacgcagactactgccgttcactccgagtcactggctcagctctatccaatttcgcagctggtgaatccctctctgtttctgaccaaacccctgttgttatcctccaccctcctacagcaaccagcccaactcctcctagcaatcctatccctccacgtgtaccaccttccccttccccctccctccaccctccaccacctcctccattttctccttctatagctatctctaaacctccacatattctttcttcaaatattcactctaagtctaaccgccaccgccgcgtcaagcctcagaagcttcctcatattctttcagaatcaagcccttcagtctctccgaaatcgaattatgattatccaactgcttttcaaaatcattcaacttattctacaacgccttctcaagcttcttctgtatggaactgggaaaatttctaccctccttcccctccagactcagaattcttcgctcgaaaagccaaccacaaccacaaccaacagcaacaacatccccatttagatactgatgatgggtcgtcatcagatgcagatgaggatgttgcaacagagagattctcagagtatgacttctttaacgaaaagcaatacacgcagcataagaagcagcagcaacaaaattatagcgagacggagcaagagg

SEQ ID NO: 17634 - DNA, 653 bp, Populus trichocarpa
  Predicted polypeptide sequence is orthologous to G1089
ttttttttttttttttttggttatactgcaaataatacaagcagtctataaatacaatattttctttggatattcatttgcaaggtatacaagaaagtgtacaaaatcctatatcctgctaaacacttttagcctgcatttcggcgctgtgatatgaacctcaagttcctatacatttctgaacaagcttgcgcaatgtcaaacatggctctgaagagctctggcaagcaagttttaatacttgccaaagacttctccctcacctgaaggcgctgcttcttataggcttcttcctcctcttccaagcgctttttcactgcatccacaacaaactgtctatctgcaatagcatcattgtcagatttgtcttctgtcaattcaggatcgaattcagcgggcattttctgctgcatatacttatggtaccagtcttcaaatttcctcgtcttttggaatagttcctttcttgtttcctcacatttctctttcaacttcatctcttcttcttgatgctgcaggatggtatgaattacagaggcaaaattatttatagcagttcttgcaacctcgtccgggagtttgtccaaaaaatcatgccaagcaataagaagtgactggatgggggggttctggacccttggtggagaagaaac

SEQ ID NO: 17635 - DNA, 866 bp, Populus trichocarpa
  Predicted polypeptide sequence is orthologous to G1108, G2394
ttttttttttttttttttggctattgggcaaactggaaagagagtgccacacagattcttaaaagagatttttgatccatgagattcataaaaagagaagaatgaaaaaaaaatttacagcataatcaaaatcgtaattatttatgtatgatattactattttgtgttatatagaggatcaaaacactgcaccagccccgttttcgacccgtctctggctagaacttaacccagagagagaacctaaaagactttcaccgacctcactcttgcaaagaggacatgatgcattgatcttcagccacttatctacacactccttgtgaaagaaatgagaacatggcagctccctcagctcgtcattgtttgcaaattttgccaaacaaatgcagcaaactgcatcttctcccgagatcactcgttccttttctgttcctgcagccacgaccccaccatcactagctcctgcactgctatcctcaccatttctatttttaattaacttaaacttgtatgttggcaaggcatcaattgattcagttgtggctccccttgtctgtgtcagatcctctctatatccaagaacggaaattatacaaggcaagcaacagcagattgttgcacacagaatgaagggcatagcgtatccgatacagctaaatgtaagaaacactatacataacctgtacaagtttggagcctcctcagcagatgagtggcctccaaatatccacacattgcccaccacaaaccaaactgcgaaaaagcaatccaaagccattttgaagtattccaccaaaaccttgagtcttgcatttagtactgcattttggctgcctctaggtgatgtagtggcagatcggcgc

SEQ ID NO: 17636 - DNA, 885 bp, Populus trichocarpa
  Predicted polypeptide sequence is orthologous to G1129
ttttttttttttttttttgttaatatatatcgattttattcatactatgtcgaaagtatacatacaactatatacgtcatgtacttagagaagtaaaagaatcaggaccaaaggcaatgtgaataaaatcttcttcaggaattgtataaattgatattctgattcacatctccatcttcagattgctagcttcaatagaacctgtaaatggctgagttgggaaggatgtttgtcttccttgatcaaaagctacattgtaaagattttgtagatcagcatcccaggctggtgggggatgggcttgagtgaagcaggatgagtcaagaaatgtttcaggaatagattcaggagaactggtggtccttttaagccccatatcaggaggatctgtccccatatccaatccacagcatgtaactaattgttgttgtgctggattaaactgaaggtatgcaggattagtcatatctgatgacatcccaatggtgggaaaattgactgaacaagcaggaaaggcctgctctctggcaaataagttgtcaaagttgaagtcaagccttggatttacagcagctagtttcattgacaagaactctacttgtctctgaagtgattgaacatagttaatgatctcatcaagcatgcctgccttaccagtgattttgttacaccctggtaccaaatcttgaagatacttcattctttcactgatttttttccctcctcactctttcagctaagctgtggctatcagtagcttgaccgcgacgtgccctgacatgaatgtaatccggcttttgaacctcagttactttggaattgtccttcgaattcccagcagaactttctttgttactgttattgtttttgttggtgttattgttg

SEQ ID NO: 17637 - DNA, 509 bp, Populus trichocarpa
  Predicted polypeptide sequence is orthologous to G1140
ttttttttttttttttttggatccctagcacacatgagttttactaactacaagcagacatgacaagtgcacatatgaattttattaactacaagccaagatgtaatatattttatttgcaaggagtagtaatacactaataattaaactgatgacttctaagccattaaatattgctggataaccctccatctttcggattcaatcaggaaaaggtaaccctagtgtaagaaaagcacaagagctatcgttgtcctggcgaggatcagctgagctcatactgctgatattggtcactaaagaatctggggattggcctggttcgagcaaatgcccttgtgctgctgataaattcatcacttgttgcttcaatcgctggttctcttctgctaattgctcccccttggtcttgagagcattgatatcctttgtacttttttcctccttttcttccaccactcgacgcaagcttccttcaattaatttttctattttttttagttcttccc

SEQ ID NO: 17638 - DNA, 392 bp, Populus trichocarpa
  Predicted polypeptide sequence is orthologous to G1145
ttttttttttttttttttagagaaatatattgaccatacgaaaaagaactagctagcatgggaaaaatcccaggacactccaacagtgaaaattacatatgaaaatttctaactcaacttttcacagaatagatacaagaaagaaaaaaaactcatgatgatgagaagcaaactcacagcagtgaatgtgacaagcagctgcttctaagagtaaattatgagcgcaaaccagaaattctttgtatctacaaaacttcatttgctagaatggggctgatgttgttctgcgaagctgatatttgggctcagggagagggacacatggcaacatattctccagctcccttagtttcctcagcctttcattttcctcttccagccgagaaatttta

SEQ ID NO: 17639 - DNA, 873 bp, Populus trichocarpa
  Predicted polypeptide sequence is orthologous to G1145
ttttttttttttttttttcaggctgaaagaagctagaaaaatatattggccattcttttgaaaaatcttaggacactcggacattgaaaattacaaatggaaatttctagctaacttttcacagaatagatacaagaaaaaactcatgatgatgagaagcaaactcacagcagtaaccgtgacaaacagctgcttcttaagaggtcaaagagtaaattatgagctcaaaccagaaatgcattgtatctacaaaacttcaacactctcgtttcatttgctagaatggggctgatgtcgttctgcgaagctgatacttgggttcagggagagggatacatggcaacatattctcaagctcccttcgtttcctcagccttccattttcctcttccagccgagaaactttgttctccagctcgcttgtgtaagcctgcttccgtgctcgtgaacgggcggcagattcacggttctttatcatcctcttctgcctcctctcaactgttttctcaaacatatttggcacacctctttttcttgctggtgtctgtgtatctgataaagtccccatcaagggtggaggtaccggcacctggttttcagggtatgaaacatccatcatagaaccagcacccatgtgaagtggctgtggcataggctggcctggcatataaacccccatcatgctttgttgtggatgttgtactgtggttgtggggggggtattgcacccattgactttgttgcagaaactgttgtgctgcatttgtatcaaccaaaacaacagaaccaccatctttcttgtccacggatgcttcagctacaactcctgcttttaccaagaaatcctcccacgtcatctctccaaaagtaggc

SEQ ID NO: 17640 - DNA, 709 bp, Populus trichocarpa
  Predicted polypeptide sequence is orthologous to G1146
cgaagatctgccatcctactgaattcgacttctatttgtgtagtcacgctgggattcagggcacaagccgtccagctcattaccatgtactttgggatgagaacaagtttactgctgatgggctgcagtccctgacgaacaatctttgctacacatatgcacgatgcacgcgatctgtttccattgtgccacctgcatactatgctcatcttgctgcatttcgagctcgtttctacatggagccagagacatcagacagtgaatcaattgcaagtggcatggctggtggtcgaggaggtgctggtgggggtcctcgtccaacgcgtggacccggtgctaatgctgctgtgaggcctttacctgccttgaaggagaatgtcaagcgggttatgttctactgctaggatcgttggaaatcccttacttttcgataggcatttaaattttacgagttgaagctgttctgttcggaaagcgggggaggcccctgcttgctctgaagcagaatatcaagctggctatgctctctgctttttgtgacgtctggccagttgatatttgcttttaaattgccactgatactgtcgtgatcagaaagctgctttctgctcatgctgtgtgtatggcatcgaatatcattgaatcttaaaactcttaatcctcctctggaaactgggatttcatttttcaaaaaaaaaaaaaaaaaacc

SEQ ID NO: 17641 - DNA, 875 bp, Populus trichocarpa
  Predicted polypeptide sequence is orthologous to G1146
ttttttttttttttttttagacagcatcttaaaagtcttagaattcaaggcattcaatgtcacacaaagtttgaagaaagcgaaaaaagcaagaagttttgaacatgtaacccaacgctgacacaaccagcttgatattgcatgtaagggtaagcaggggcctcccagggatttaaacaacaatccaaaagtaagggctgtctcgaatcctaacagtagaacataacccgcttgacattctccttcaaggcaggcaggggcctcacagcagcgttggcagcaggtccgcgagtggctcgaccacctgctcctccacctcctcgtccagcagccatgccacttgtaagtgatccgctgtctgatgtctccggttccatgtagaaacgagctcggaatgcagcaagatgtgcataatatgcaggtggcacaatggaaacagaacgcgtgcatcttgcatatgtgtagcaaagattgtttgtaagagactgcaacccatcagcagtgaacttgttctcatcccaaagtacatggtaatgagctggacggcttgtaccctgaatcccagcatgactacacaaatagaagtcgaactctgttgggtgacaaatttttgagtccacgacagtgccaggcaatatattcccgctccggtcaacagcattacggtcacggtgatcatttgcgaacagccttgtgtgatgacgcttctgaaccacaacaaatgtcactggaggctggtagttgggctctaaagaagcacatgccttacgaatagcatcaagttcgtgcaacaaaacttgatagaactgcccttcactgacaccatctctgtagaatataattctctgaggcttctgccctgtggctctccggaa

SEQ ID NO: 17642 - DNA, 733 bp, Populus trichocarpa
  Predicted polypeptide sequence is orthologous to G1150
agaaccagttttctgacgaaaatataccccctgggactgtcgtggacactgtgattacacatccaagggaatttgatttctatctatgcagccattggggagtgaaaggtacaagcaggccaacacattaccatgtcctgtgggatgagaaccaattcacttctgatgaactacagaagttggtttacaatctgtgctacacatttgtaaggtgcaccaagccagtttctttagtgcctccagcttactatgctcacttggctgcatatagaggcagactttaccttgagcgatcagagtgcatggcttccataagaaatgcttctacaatctcaagagcagccccaccaaaggcagctcctctaccaaagctcagtgaaaatttaaagaagctaatgttctactgctgatttttgtctaagcctatgaattcttcaattaatgactggcatcaatacaaacagcacctagctccaaatgtagcgcagcccatttatcactttagtggctggatgccaacgcttagaacttgcatgatgttaagaacctcctcctcgtagcaaaacaagaaaccaagagttgtgcatttctttgtcaatgaactatgacgcatgttcttgtttggcaggaagttgtctgaatggcagagacttgcacaaacagcgccattctttgtctttacttattttccgcgaagaagcaaaactattcccttaaaaaaaaaaaaaaaaaa

SEQ ID NO: 17643 - DNA, 712 bp, Populus trichocarpa
  Predicted polypeptide sequence is orthologous to G1190
ttttttttttttttttgggcttggaacaacaacacaagggcggattggagtgtaccatgctgaatctggctcaagactgtcatcacacttgggtgggtaggcatcagtattagcaagcttactatagcaactattatcagaagctttctgccacacagcaatatcatcctttttgtcgtacaatttgaagcacattgaagtcagcagttcttgcaacttttcataatctgatttctgctcttcgacagtagtattccagcctcgccaacggttttcgtagttaacaggaggaccagacagaacccagaagccaccaggacggagtatacggtgaacttctaaaagataaattccaccgaattctgtccatgggataagacatctggagcaatgagccatatcaaatgcattcgatgggaatggaagccgttgtgtggaaatgatgccaagaattgcaggaattccacgttctaatgcaaactggacttgagcctcatggttatctctcggagcaagggaaacggttagaatcccacgatccaatagatcacctccccagctagcaaccccacacccagtatcaatggcagtgcgaatggttccgtctttcatttcagggataagatcttgcatcaaatcgacataggctcccactcctcttggaaacatggttcccccaccaggaaagaggaacttatccccctcttttctc

SEQ ID NO: 17644 - DNA, 852 bp, Populus trichocarpa
  Predicted polypeptide sequence is orthologous to G1190
ttttttttttttttttaacagcgcaaggaaagtatagtatagatgccttacaaagaatctatttgtacttaaatgattctataaattaacaaaattctgttattgagtagcaactcttcaattgcagtgtcgaccttgtggatccttggcttctattgaatatactaatatgtgtgtaagggattcaatttattacttatctcctcaactcatcaacccctggaattctgtattgcagttacatgagctctctctccaagagatgcatcggcatgttttggatctctttgtttgtcaccttgaactttttgaggagtaccagagtttcttctggcagatcaatattttctccttctcaactccatattcggtgtcttctttacggcagctccacctcatacccttggcaatggtagaaatggcatcgacgaaatagctggattctcgtatcattgcataaccggtgggtcgtaggattcgatccatctccaaaagcacatacttcatttcacatctatggctttctgcagtgaagaggccatcaagatgaaggagatcataagttcgagggtaagttgagaaagcttcgcaccaatcatgaaaagtcccgatgaggccacggtcaaaaaccacaggaagagtgttggcagcataggaagagaccacattcatgacccacaggggatcatcaatcacagccgcagcaaaacccccataaactgtattcatgtccattatatttctcatcttatcagacccaagtgctggcagcaacttcttgtagtgctttgcacgaatcttccacttgctgtcatcatgcttaaaagcactagcacttccaccaggaatatc

SEQ ID NO: 17645 - DNA, 896 bp, Populus trichocarpa
  Predicted polypeptide sequence is orthologous to G1226
ttttttttttttttttttgccttattacattttcttgttttccatagaaagggcagagtacagtaatattagtaatcctataaattcagctgtaaatttgatggctctcttgcctagcagaactcctaagtcctatcatatatagacccatcagctaaccgttgatactgctgaatatttgatgagctgctgctgctacctcatccgttgatcccagcttacaattatcctctaacttaagattgaaagagtaaagaactgttgcttgagaagaagtgatgttaaggtgcaaaaccgtaagccccaggtcctccaatgcaacaatagctctcaacaactgcccaggaattctttgacactttatcttcaaatttacatggttttgtactgcagccacctctatctctgttgcctccgatttcttcttcactgttctttcctcttcacaagtgcctccctcctccaacagaaggtcacattgtggctgcgaagtacagtagtggttgggagaaatgcccgcggtggaggctgtttctatttctctaatttttttttgtgcctcaagagattgaacaagctgctctagttccttcacaaagtctattgcacctcctatgatcgatgcttgatcacccttttgaatataagatggtgtcatgagagagcggagagagttaagatggtcgttcattaggcgacggcggttgcgttcaacagcaatgtggttcatgcgttggctctctacttcttctttgttcttggttgcccttgtacgttttctctttcttctttctcttgtgattattaatgtagaggattcggagaaatgggttgtcatattaggcacggtttggggctgagccctccatggaattgaagagtctgaattgggttct

SEQ ID NO: 17646 - DNA, 829 bp, Populus trichocarpa
  Predicted polypeptide sequence is orthologous to G1229
ttttttttttttttttttgctctgctttgaaaacatgatatcagtatcaaacttttgaacaaagagttcagcatcaagtctcagtcatcttgagatttgaatgcccaaacatattcagatgctcataaaataacatttttaataatgcattatgcattagaaacagaacatcaaacaaagagttcagcatcttacgcatgaaagtccacacattaaaccaaaagaaacacaaatggccaagcaaacatacgcccttacttctggaggcttgtacgataatgggcaagcaacattatttttttgactattaatcatcaccatcaccatcaccatcttcctctacttcttcttcttctttccacccattatctcgggtccactctctattaatgcttgaatcttcagctacttcagatacctctgagtgagcactcattgaaccatctggagtagtagcaaattttgtggtcagctttggacattgatggaccttcaacttctccaaacgagggaataagaaataatcacaccatccgaaactaaaacagacaatacttgataattgttgtagcgacaactcctttagattaggaagcactatctccttctcaacgttgataggtgaagcttgatcatcctgcccaggagactctggaattatttccctttcaccatcctcttctctgattatatgcttcaattgaccgcatttacttatggaaagcctttttagctttggcagacttcgagcgagggacggtgtgaagataaatggcagtttgtctagagaatccaaaatcagaatattaagactttggaggctgacatc

SEQ ID NO: 17647 - DNA, 410 bp, Populus trichocarpa
  Predicted polypeptide sequence is orthologous to G1242
tttttttttttttttgggcctcctaacatccaactgcaatagataaaaatattgcaacagttgagatctaataatttgttattggccttctccacaagaaaagaccacgggctgtgattaacaaaaagaggggtactcaccatgatacttgtacaagtttgtaccccctaaaaaaatcctataataaacttaaatcacttcttcctttttcccatgtttgggtaatcatccattgataactgtttccgcttctttagggaaggagggctgtcggtctgtcttcccatggaacgcttggacggggtcatgctctgcctggcaagcttcttttctttacgagcctgtctctccctctcatcatattcttggttttccttctgggggggggggattaatttaattaaactagt

SEQ ID NO: 17648 - DNA, 557 bp, Populus trichocarpa
  Predicted polypeptide sequence is orthologous to G1246
gcatccttacccattttatgagtggggccttttaactttctttaaagccagcccagacaccctcctttgaacttcactacttcggcaacattaagcccctcttcagaaccagacacaaagaacctcaggagctaaaacccaaactcctctctctctctctctctctctctgccttaactacagttccttctgagacactctagcattgatatctgcaaaaggagcccatgtcttctctttccttttgcttctcatgagaagcaaagtccttttttctcaccgtgttttgtttcgctctctcacaacgaagtcatggaagagacagaagagtccagtggtaacaagaaatgcaccaccaagaccaggactttcagaggaaggaccaacactcacaagcatcattatcaccagtatcagtatcagtatcaatatcactatcactatcagcaccaactcttgcaatactcaaatcaatatggtttctttaaccataaccagtacccgggttactacccagctcttcttcctttacctccaccaaaaaaaaaaaaaaaaaa

SEQ ID NO: 17649 - DNA, 825 bp, Populus trichocarpa
  Predicted polypeptide sequence is orthologous to G1246
ttttttttttttttttttattcttttatagcttttttagttgttagtcattgttttttaattattatttatttatttaaagtaatttataacattagattattttttttcaattttatttaaaaaaaatattaataagtgatttttagcttgattttcatgaccaaatataaaaaaatattttacaactaattttctatgaaataactatccactaaaaaataattactttacatgaatttactttacataagaactactttctaaaaaaaaaaaaaagtttccggcaaagaaactggcctaaattaaaatatcaagtggcatgtgttcattttccgatgcatgcaatgcatagatttatggtaaaaccgtgtccaccactagtatattgagactaaatcgccagtaatgttctcgtaaaacacggatctagatccaattacacaaacacttggcagagaggttttttttttttttattaacagaattcattgattacaaattcatgaaagaaaaaaaaacaaatcaaggagaatattatttgacagagaagacaatccagagtgtctgattgcaatacaaatgaatggagaattaaacacacgcagagctctggaaatcgaaaacactacgagtctttgaagttgatactgcagttgatggctgtgtgtgtgcgtgtgtgtttgggacatgaagctatgtggaaacagaggagctaatcaatgcaaggggatcaaatggtagaggtcgccatgccagagtgaggagaaagagaatacctgaagaagcagaaccgtgagcgcatgatcggttgatggatgttgaa

SEQ ID NO: 17650 - DNA, 931 bp, Populus trichocarpa
  misc_feature (830)..(830): n is a, c, g, or t
  Predicted polypeptide sequence is orthologous to G1249
ttttttttttttttttttgtaaggatacaaattgagaattttaaaccattcagtaattagcaacacacatttagcataaattacttcagaatgattgattacttgactcattgccactctacatggcgatgaaccggccagggatatctacgtttgttaattgagcaaattccatattgatgatagcattgttggatgcgcatgatgttctcattgaattttatgcgctgactatcttgttgtctctacagccagaaaaaatgtcaggaacgctgaaggagcagctagatgcaatcaccccagctctccgggagatgcgtctaatgtgtggtgagctggcctttgcatcacaggaaaagaaggtcccaagctatgtagttgctgggcaagaaaatgtggttgggtcaaggccagacaccagcagtcgacgtctttcaaacaggagcttaaatggaagcttgagcaatgcaacccctttaaacagaaggctttcactttgtctccaacagttgggaaccaacagcatcaatttttataaaacttgaatatttgccgccttggtgacgaaatgatcgatccggcgagtgccagccggggctggtttatctgccaaggtacgagcactagttttgtcactcgcagacttctccggtgattgaactggcagaggaagagattctaagagggtggtgccttttaacatcgactcaaacgtggtcgagtttcagtctttagcttcagctgttctcgattgcagtttcagctgatttctcggagaaacaactcggtggagctggagacgatgaaaagagcatctgggttgaccttgntgatgtctttgtcgagattctcttgatccgacctgctggggattcgggtctggttgttgttgttgcttctgtgttgttctgagaatgtgaattctattggg

SEQ ID NO: 17651 - DNA, 871 bp, Populus trichocarpa
  Predicted polypeptide sequence is orthologous to G1255
ttttttttttttttttgaaaaatccacatgaaaattttttcctctgcgcagcaaaagttagcaggaaggaagggtacctatacgaagttaccaattgccaatgctctactacagcacaaaaacttattatttattaaatctgcgaagaccctcaatcagagctcctatgtaatgtgcatatcagcgtcgatcgcaccgcttggtgcaagcaaactggaacctcgctagagcagtccatatttattttcctgctaaggttgtcctcttaacaaatctccctttcatcctcggcctcttctctgcattcaatttcctgacctcgtatcttattttcttggagaacaatcttgttctccgcttctctctatacctggatactcttgcctctcgccctccatccaccattgcagggtgtgcccctagtccactgatcatatctccataaggatgatgaagttgggctccacaaatacccatgcagtcaggccaacattcatcagggtcgaaatctggcctgttaccattggtccaaggagacccttggcttgcccaagcggtcatgacagcctcataatccagactcagcagtatcttcctctttgcaccatcatcatcttcgtattctcccctggtgttcttcaagtctccctcttcaatccctaccttctcatcttcctctccacaagttgcagaagagttatagtcaaagctcaactcaaaaatagggtcttttgccatatcagtctcaataccagcataacatttcctaacagcttttctttccacgcttgcattctcttcatcttcaaccttcacctttccgttccataatggaaacccttttcacctcgaactccttttcttctttaca

SEQ ID NO: 17652 - DNA, 619 bp, Populus trichocarpa
  Predicted polypeptide sequence is orthologous to G1255
ttttttttttttttttttaacacattaaatttttatctttttgatttttataattcaacaacatacataaaaaaaaatacaaacacacccacatctctttttattatgtttttctcatacacccatatataattacaaataataaataaaaatttaaaataaaacaaccatcacacaaataaaaaatcacataatagcccctaaaaatatccaagaacctgctgggaggcttctggaccataaaaacagtggcggcgcgtctcctccacacgccgccgccactgcggcgcgtgggttcacgcgccgccgtaagagatatgacttggcttcctcccttcctcgccggcggtgacctgtaacaagaaaaagaaaacgcaggcagttgattttaatctattctgtccagattgttcttgtgttttttctttagaagcggggcggcagtcagggtcttctggtttactgccaaaggaaagggaaatgaggggagtggagatagtccacaagaggcaggcaatctctggtttggtttcaacgagaggggggtgcggccgacctctgtcaacagggaaaaggaggcttgcggctgttgagagaaaattttaggtttagggttttc

SEQ ID NO: 17653 - DNA, 842 bp, Populus trichocarpa
  Predicted polypeptide sequence is orthologous to G1266
ttttttttttttttttttctaacactctaaagatgcaattatatttgtgcatttgatgcactctaaaaccatacaaactgacatcttctcatatacaaaacccaaaaaacgataaaaagaaaaaaaacacaagacaaaaaagaaagaaagaaagaagaacgattcaaaacgttccaggtagagatttccctcgctatctcaacaaaattaagcaaaagcgagtaattaattctcgaggatatccgacccctgacggcgtgactccccacttgtgctgctctctgattcagattgtgatgttgcaatagttattgtgctagagctaccgcatgaatccatagcttttttacttgacgtccttgttgagctaaaaattggctgacagttttgagttgatatagcagccaccacttcagctggaaaattaaggagggccttagagccacgcatgttaaaagcagccctatcataagccagggcagccgcctccgccgtttcgaatgtgcctagccatatacgagccccgtgtcttttggagtcacgaatttctgcagcatatttcccccatggccgacgcctcacgccccggtaatgcttctttgctatgactgtcctcgctggttggagcatgcctgaagtgttgatttggcttctcggaagtatattatatgtactgctattcggggcgctggcctcgttgatcatctgatatatgaccatgtcttgtgagtcattctcattaaaggggagctcatggatctgggagcttaataccatggtttgcttattgctcggaaggggatttggctgcagttgatttcgtgggatttttggggtttcgc

SEQ ID NO: 17654 - DNA, 844 bp, Populus trichocarpa
  Predicted polypeptide sequence is orthologous to G1266
ttttttttttttttttttgtattagaaatctagagtagattaagtagatgatacaagactcactttatcctctaataaatgaaaaagaaactttacagagtgtgtagaaataaggatggacaacaagaaaggaaagaaactcttgccacgacattacccctctcctcatcttaggaaagacaagggaaaaagaaaacaaaatcaaaggtctgcaaagaagaaagtaattgacaaataaaggaattaaggagatgaaagcagtctgacttcaccaagaactagagctctcacatgaattcagaagctcttcaaggtagtcagctcccaaatcctccaaaaccaccacattttgttgtctagtattagctacttgattcactttacttttcctacttgttgattttcttctcacggagtgtctcctcttaagtgccaccacaggcgaacacccatcttcacatctatacttcatgtcttcaagtgattctctcaccatctccacagagaaatttagtacagccatcgaaccccgcatggaaaatgctgcttgatcataagccaaagcagccgcctctgcactatcaaaggttcctagccaaacccggacgccatttcttgtagaatcccttatctctgcagcatacttaccccatggccgcctcctaacccctctgtaggatttctctttctttggctcctcttctttggcatttgaagtcacttcctcttccttaattccactcgaggaattagattccgaggactccttggcaccatcggcgcctaaatcattaaacagtaccatctcccctgagtcactggtgttaaaaggaagggaactgct

SEQ ID NO: 17655 - DNA, 635 bp, Populus trichocarpa
  Predicted polypeptide sequence is orthologous to G1272
ttttttttttttttttgagaaaacgacgttcctggagcattcagattacaaatttcaagcatgcataaagcaaaatcatccacttacaaaataccatataacccaggatggtgcatgcaccggattttgcttgctgacgttgtgtacagaaacatgaactgaacaaaatgcaaagctgtgacaagccatcagcaagtgaccatacctagaggcagtatccaagattccaaaacgtgtcaaatggcatcaccatgcctaggtgtagtaccacatatttgctgacttggatccagcacatggtgttcaactaaactccaccacagcaaggctgcaccaaattcagaaaccccaaacacctgctgtctatctagttttatttacatagagtaaaaggctagcatgctcaacaaaagaacatcgaattgcaaactttctcctgcaacctcggtaactgtgggacaggaacagctcctgcagaggtcaccccaccatggcttgaggaagtctcagaagtatcttcaaacttcataaactggcccatttgagtagctgccaggtgggcatagcagattggtgcaactacagagatggcagtcgtgcttctttggtatacatatgagagggaatgcacaagc

SEQ ID NO: 17656 - DNA, 840 bp, Populus trichocarpa
  Predicted polypeptide sequence is orthologous to G1273
tagtaatataagctgaaagaataactgttcatgtgttgaattgtgtagaagatttcttgtttccaagggttatagattgaataatgttatgaactgagatagtagtaaatgagatcttgtggaagcatagaaactccttactagctcttacttattccctttctgtataatgcaggtctgagaggttgtcccagccaacagaagcgatttcttagtgtctacaaatcaactttccatctctgcagcttttgttacatcctgttgaatgtggattgaggttcaaaagataggacttccaagctcccttgatcttgaaatggccgtttcttacacgtttaccagtaaaatgtaattaacattccagatatttattgaaaatggagatcaaggaatcagagagggtggttatagctaaaccagtagcttccaggcctagttgctccaagtttagatctttctcagagttgcttgcgggtgccatcaatacttcaccctctactgattgttctgaaatggcagttgctgccattagaccaaaaactttgaggtttaggccaacagtgaatcgtgctccaggtgcattggtttcttcccaggttgaactctctggaacaacacttagcaattcatctaatagagtttcaagtactgatagcaaaaccactgtcatatataaaccacaggcaaagtttgtgtcgaaggcaactgtttctctactggcgagtatggggaacttcaataccaattcacagcaaatgctacaatcagttgaggctcgccctcagtgtccaaaacaaaataaacaaaatttctcatcccagctaacctcaaatcttcatc

SEQ ID NO: 17657 - DNA, 888 bp, Populus trichocarpa
  Predicted polypeptide sequence is orthologous to G1273
ttttttttttttttttttgacttccttcgaaacttattctgaagctaaacaggcgtatatattacacaggattagccaaggcaataactgagagagagggaaatgtactcgtaagcttaagataggccagcaaggataatgaaaacgagacagccatttcgatattaatcctcgtcaccaacacaaaaccggcaccacgaagaagcctccagaactgaaactgctatgttcttgttttttattgtctatttgcttgtgttatttagcttcttgtgcgctgaactctttttgatatctgggacagaacaagcatcgagatttcgcccatccatggttgagatcacagcttgtctctactaggaggtgcctgtagatcagggttcaaaggctgtatatttgtactcttcagaggcatctcatggttatgttttccttcatatgttgtaataaaagcttttggatcgtctgatgctctttccacatgcttgcgcacattgcatttgagactagtacatctatagtaactcctgggatatggattcccccttacaatcttctgcccatattttctccagcgaaaaccatcccccaaaatctcagaatctgtggaactttgcaccactacacggggctcctgaacgccctcccctgatatgccacctttattggattgtatcccagctttccttcttttatttctaggttcatcatcgtctccctccaatcccttgcttccatcattacattccccattgagaccacatgagttatcagaagttcccgcaccagcattaattgatccagttccagcacgatcacaagatggcggaggtttaccctggtaaaatgaatgcacctgtaatcctgtttcgatctgattttcctctc

SEQ ID NO: 17658 - DNA, 877 bp, Populus trichocarpa
  Predicted polypeptide sequence is orthologous to G1324, G2893
ttttttttttttttttttcctttatgaaatatcttgacaattgataaatgttggcacaggatcaaaatccacagttactgtttaaaatttggtacaaaaattaacaatggcttatcacacaattacacaactaatccaagaaatataaatttgtcgctttcgtgactaagtatttgtgggttattccaaaaacaagaccttaattttcctttccttgcaagttcctaaattgccataattcatccatgttccacatagtatctccgaaatcgtatgcaccccaatcaccatcttccatgtggcgatcgccagctgagatcccaagttctccaggcactggcatcgttgctaggttgatggcttccatgtcatagcaattgctgtcaacataatagcagcccttcgccaaggtgctgtactcactgctgttgttgcctatggcttgaaagggacttgtagggtattctgataattgagacatttgtgagacattcattgattctgctgaagaaatgcatgaacttgtgccaagctctgagtctgaggtttgttcatgaggctccaaataatgcattgtcacactcatatcaagaggagcttcttgctgctgtactagtggggggagtgctggcgggaacgttgaaaactgaggagcataattgaggttcggctgagaaactactgctggtctttgggatggcatggctgatgaagatgttgacgatcctcctatcttttgaagcaatcttggcatccaaaaccacctaattatattctgaaatgctgtgctattggcatctatcttaaggtgccttgcttgtttctgcactctagttctccaatagttcttgatttcattgtcagttctacctggcaa

SEQ ID NO: 17659 - DNA, 393 bp, Populus trichocarpa
  Predicted polypeptide sequence is orthologous to G1330, G2423
ggcactgctgcctcatcggactcgtttgctactcaagtttcgcctgtctcggacttgactactgattattacaatatcccggttaatcgtaacaccaatccggattatttccaagccggccaagttggctactcggagtccatgattagtccacctggtttttttaaccacgggttagatttccaagccatggagcacagcagcaatcaatggccaatggacagtggggacacatcggacaatatgtggaatcttgaggatatttggttcttacagcagcagctaaacaacttgtgaaaagggaaaataatatgggtgagagcgaaggttaaaatgcagagaaatacaagatcatgggggctagtatagctagccaaaaaaaaaaaaaaaaaa

SEQ ID NO: 17660 - DNA, 737 bp, Populus trichocarpa
  Predicted polypeptide sequence is orthologous to G1330, G2423
ttttttttttttttttttctttttgaaaactgagaatcagagcaaatacctttgcgctgcttaataacatgaaggaaaaataataattcgtcttcaactcattcaagtaaccaaagaaaactacaaaactcaagagaggtccaagagttgttacaaattcaggattattcataaacctaaactctatctttgatccaggttcctcaactgaccacttacaagcagcagaagaatatttaatctgagtcttttattgaaacaaacgaggccaagtaatgaaacaggtcttccggaacagcctctcctctgtattttttctaatccaaacctcaaatgcgcatttaagctgctttgcgtgcttttgtactctggttctccaatagttcttgatttcattgtcggttctccctggcaagtgttgtgcaattttagaccatcgattgccccatcgagaatgaagttcaaggatcatgagttgttcttcaagagtaatgtttccacgtcgaacatcaggccttagatagttgagccatcttaatctgcaactctttccagttcgtttgagacctgcacaacgagccagagaattccagcgtccctcgccgtgagtagcaatgtaattgataagcttgaagtcttcttcaacagtccatggacctcttcttaagtcacccatcatctcctcatcactttgtgtggtggaggaggagctgttgctgttgcctttaacatccatc

SEQ ID NO: 17661 - DNA, 589 bp, Populus trichocarpa
  Predicted polypeptide sequence is orthologous to G1341
ttttttttttttttttaaatcacaatatcaaacatggattaaaacaactagctgtctacaagaatatgatacaactatttaagaacctcactatgcaattcctttttttagaaacaaaggattggaaaagcctgcaagattctcaaaacactccagtagttctattttcacctattatgccttacaacttggagcccgggatcccatctcttccatataggatatgttactatcattattctcttctgtttttgcatttttcatgtacgtaccgagatcagaatacatctttactgttgccttcgaaaactcagccaaggactcaaacactgaagaaaatcctctctgaaatccatttatggtgatcccatgtgtctcttgcatgctagcaaggtgctttccctgctcttcatctagcctcttcctgaacatttccaattgatttttcctttaagctatgtattctatgcagttacgcgccgtcaatttagattcctgctcagaaatcttggattcaagaatcctcctctctgctctctggaatgccagagtcctcctgtcaagttctttggccaatccatcaactttc

SEQ ID NO: 17662 - DNA, 685 bp, Populus trichocarpa
  Predicted polypeptide sequence is orthologous to G1341
gaaattaatgtgaaggtgtcagtgcccctgtagttcaggttcagctatgagaagcgtaaccagctggtgtactgcctgcatcccaggccgtaagcagaaagaaaccaagactgaagaatcggagaaatctttaaggaaaaaaccttcccgcgaagaatctagtggtcctgatgaccaagctgaaggcagcagccatcaaggaaccacccatgctgccagtagtgctgatactggtggcgcagctgttgtagttatgactgcaacccaaatgtctgacatggaaggtagttctcatggcggcggcggcggcgggggcgacggaggtggcggtgacggttaaacattaagcagtccccgtttgattgtgtttgtgactcttttgattgatatcgtaatggttttttctcttggattattatcactgctgcttgcttctttactttccttgtttcaagttattgctctgcgtggctacaggaatgcgaaaccaggggatctgggatggaatctgtaagatgttgaaagccatggttgtgatgagcgcgatgtttttttctttattttttagtattttcctggtgtatggtgtttttgaggaagagaggggatgcatttgtgctctatgttcagatctttcaatatttatttcccacataatatttttgttagaaaaaaaaaaaaaaaa

SEQ ID NO: 17663 - DNA, 889 bp, Populus trichocarpa
  Predicted polypeptide sequence is orthologous to G1382
ttttttttttttttttttagaccataagcaaagatatatatagagcaatacatattcttaaaattcagattctaaccttttgccatttaccagctgtaaggcaaggatgcgggaaacaaatttaaaactcagacaaacttatggacccgttaataatcttcccatgttctgcggatatggataaggtggaatttcaatgctacggctttcacctggaatttgcctagatccatactgattcatgccaccatttaaaacaccatagtaagccgtaattggggttgcatgaactactctgaaactagaaccacttgcttggttctcgtgtttgataagttcagcatgcaaagcttgttgctgatcgctggactggttttcagttgtagaactgatcccgaccccaagatcaaggctaattgtctcgttttcatctggtctaatccttgagggtccattcacagctgatggtcccgccatgtcatgactgtttgtcctagctgtaggtacatcatgattgtgtttcccctcatatgtggttataactgcttttggatcatgcgatgccctctcaacgtgctttctaactgggcatccagcatttgtgcatttgtagtaactccttggattaggatttcctctcaccactttctggccatatttgcgccacctgtacccatcatccagtatatcaacctcactcagagtttgcacgacaacacgtggttcccggataggtttgaccactggagtaacatcaaaacctccagcatccaacctccttctttttgagaagggatcatcatcgtcttcggcaccttctccagtatcatcatttgctccagtagacagttcaggggcaccatttggctcgatagcatgaggcacctgt

SEQ ID NO: 17664 - DNA, 325 bp, Populus trichocarpa
  Predicted polypeptide sequence is orthologous to G1419
ggaaaagacttagagagtgtgacgcggaagagagagaggatgttaagagggttatgcgagtggttaagagagaggaacccgagagggatgttccgctgacgccgtcatgttgtacggctgtgtgggatatatgtggcgattcaaagggtgtatttaacgtgcccccattgtctccgttatctccccacccgtcgttgggatttccacagctactggttatttgattagaattgaattgccgttaatctttttattaattatttactcgagttttttcttttaagtgtatatatagaaacagaggaaaaaaaagcatgcaatgtaa

SEQ ID NO: 17665 - DNA, 519 bp, Populus trichocarpa
  Predicted polypeptide sequence is orthologous to G1419
ttttttttttttttttacaaaatccattccattgaataaatgcaatcaaagaagaaatgcaatcttacaaaacttatcatcttcaacaaacgcaatcatagttgcgtatatgaaccctactaattatatatagctatgtatagaaacttcctaatctctacttaatcggcgacacttttggccatcagatttttcctaattgagtaaacagcaaaccaaccatccaaacgacatgttgaccgtcaatcattcaaacaaccatcagccttgaatacccaaatgaaggatggggagataacggtgacaatggtggcacattaaatatccccatgacttcaccatcccagaaccccttccaacttgacggcgttaatggttccgtagccgctgctttgacctcagtttccggcgaagaactttccctcttcgccaccttattagtgatcacagaaccagtactttccatactactctctatttcttcaatctttcttttcttgcttgaagtttccaagaatt

SEQ ID NO: 17666 - DNA, 687 bp, Populus trichocarpa
  Predicted polypeptide sequence is orthologous to G1420
ttttttttttttttttttctttcttttaaggttttttttttttttttttttttttttttttccttttaggtttttttttcaaaaaaaaaaaaaaaaaccccataagtaagttagaatttaattaaataccgatttccaaaaaaaaacccatctacccctctttagccccctttcggatcatcgggggggggacaatatccggaaaaagggcaggggctctaagcaaagaaggggggttccccaaccttctctcttgaagaaaaaagggggggctaaaacgagtagtacttgaagtaaagtttaaagagggggaggggctatacagggaagccggtttttggggggacagagggggttttggaaatacaaaagacgacgttgcggccccaaaacccctagaatcagcaaagattccaatacttcccctaattatgggggtgggagggaggggggggccttcataggttggaacaacaaaagaggggtcatcggaggatttccccactctctttttcacaccacagccgggactaggggaacgaaaataacccctgggaagggggcggtttttcacagttttcggggcggacttccccccccggtacccatcatctaggggatcaacttccctctttgtcaggaaagcaaatcccggctctcttagcctttttgggcccccctttttgg

SEQ ID NO: 17667 - DNA, 906 bp, Populus trichocarpa
  Predicted polypeptide sequence is orthologous to G1435, G2741
ttttttttttttttttttcgaaataagctctttcagattaagggtcatgacaatggaagtattaagtagtcatgaaagagcctgaatttttttattttttttgttaaagtgatgctaacatgcacatggaccatcaatatacgactgtcactcccccggttataacaagtattatcagccaaggggtttgtggatgcacgaactgtaagcataatgttttgtcattatcatcttaaggaagtctttgtgcaggcttgatagtggaagacattggagaggatggatgcactaacctcttttttctcttcctctatagcatgccaaaaaaatatctcctcccaacatcacatgttgtcattaggtgcaacttgatgtggatgatgcgtgtatgaaccataatgattcccattccaatccctctgctgaaacatatgaccatgaacaacatttccattatacccgttttgatgaccattaatactaacttggtgatgctggtggttatcactactattattattttgaccgttgttattccccatttgcatccccatatgtccatatactggcattggcatcatcccacccgccgtggcagggtgatgataaggcatcggaattgggattccaaaattcccatttccgccgccgccgccatcactactctcgggaaaactctgcggcaaaggagtggacgcaaacaactgatcagaagcagaaggtccttcactcgacaacccctgcatcctcttcaaataaagccggtacttctgcaaatgactggctacattctcgcgagtcaaaccttcaacattcatcaactgcataatcgttttcggaaccgcgtttttaatccctaagtggctgaccacgtcaacaaacctcttatgcaactgaggggtccac

SEQ ID NO: 17668 - DNA, 937 bp, Populus trichocarpa
  Predicted polypeptide sequence is orthologous to G1451
ttttttttttttttttcagagaatagagatttactttctcaaaactttatctggtaacaaacaaaccactaccatgctgcattctcctaacacttccatgacgttactagtatagtgataagagaaacagtctcctatagtaaattacaatttacagtaacatgctagataacctgaccatgcacgacactttacccaccagaaaaaggttcaagtaacattaacgttcggtggatataacaggtaccataatatagttacttgcttttcagttaattgtcatgtgatttcaggttttttatgtgcatctgccttagtagtcaagagaccccatagatgcaatcccattgcttgagtttctaaaaccctgcgtattcatgtgcccatcgctgttgctattagaaagcttttggcatgggacagaagctgcaggactgagaccttctttgcccatttgttgcacttcaagaggagataggatcttgatataccagacattgttcacaaattcctgccaaggatcatcaccaaggagaagcacatcgttctcccggtcaccaaatacaagctgccagcctgatctctgtgggtcctctaataggccttctaggcaaaacaagcgagcaagctcactgcgaagctcatcatagctgctgaacttggaaatatctagtgatcgcccgtaggaccctgacttgtgaaccttcacaaaggttcttgttgatgggtttacttgatccacattttcagaggactgtaagaaacctgattcatctacacaacttgaagctgtcatgtctgaattaagtggaatatcacttccagtagcacttgtaaaagttgaagcagcaaatggcatagacaacggatcattttcagtgccaatatttctcaggtttggtatcccatgctgaagcatgaaggttgaagaatcaat

SEQ ID NO: 17669 - DNA, 775 bp, Populus trichocarpa
  Predicted polypeptide sequence is orthologous to G1451
ttttttttttttttttttatttcatttcatgaatggcatgattgctcgtacaagtttacatacctagaaccattctgccagattctaattctttaggctcactaatgaacttacaagtatctaatccatgatagaagtcaattcttcagaataactagctagtctaagcaaaatatgtaggagtactatataatataacttgagacatgcaaagaaacagggagaggtgcacacgttggagatgggatctcgtgtaagttcatctttaactccagggtgtgaggatttaacgaactacgtggaaggaagaatgccaaatggtttacatcactaagtttcggcgagccagtggccagttcttaagccacgctgccactcatcctttgacagcatttgggccagaggattcaaaaccctgctctcccatttttaaaacgtcctccggagaaagtatctttatataccaaacattgttcacaaataactcccagggatcatctccaaggagaagtacatcattctccctgtcgacaaatacaagctgccagcctgatctatgagggttttccaatttcccctcaattccaaacatctgagccagttcttctcgcagctcatgatagctgctgaaccgggatatgtccaatgagcgcccaaccgatcctgatttgtagaccttgacaaatgttcgacttggggttggtgggtccatctgtcctgcatttggcaataactcagaagagtcttgcacacaaccatacagagaattctggaa

SEQ ID NO: 17670 - DNA, 831 bp, Populus trichocarpa
  Predicted polypeptide sequence is orthologous to G1451
ttttttttttttttttttggtcccttataagcaactgttggcattcaaatttcaatagcttactaacgaggaacattatcttctagttacaataatagcttagaaacgaggaacattatcttctagttacaataatagctttagaaactaggagcagtatcttctaatcacattacaacaatagcttacattaaaacttaagctagattaggctttgcccctttcacttctgaaactgaaagatttggaaggaatgctaatattacagaagagattgtggtatcttaactgcttaaatttctcggcagtccaaagaccccacagaagttatagcattgctcaaattttgtgaatcctgccggtttacatagtcatcacagctgccattggaaagcctctgaattgggacactgttcagaagctctaaacctcgtttgcccatttgttgtacttcttgcggtgagagtattttgatgcaccacacgctgtttacaaattccggccaggggccatcaccaaggagaagaacatcattctcccggtcgatgaatacaagctgccagcctgatctcagggggtcctccagttggccttcaaggccaaacatgaatgcaagctcacttcgcaactcattgtagttgctgaatttggttatatccagtgacctaccaaaggaccctgacttgtaaaccttaacaaaggttctagatggtggatttccttggcccacattttccatggactggaggaaacctgattcatcaatgcaacttgaaggtgccattgctggattaagagagaaattggtgcctgcaatactcatgtaattag

SEQ ID NO: 17671 - DNA, 827 bp, Populus trichocarpa
  Predicted polypeptide sequence is orthologous to G1478, G1929
ttttttttttttttttttgttagataaacattttctgatataacttaatttctttatgaggattacatggagaacaatttcagggatcctctattttttctatttttttttctgatcacccatttatcctgtctgtgtctccctcctctttccaggaataaagctgctgtggtctctgaatttggatatgctgcaaataacagaagtgaccaacttaaacttacttgtaatcattctcatacgcatccaaaaccatccaagtgacaattttgtgctccctttcaataaatctcaagaaacaaaaacccttgacccaacaccagaaaacgaaagaagaagaagaagaagaaagggacagaaaaggtgaaggaaagaacaaaaatcaaagaaacgaaaagggctttttaagtgatccagagcacttcttttcaagattagaattacgatcccttctttctctccaactcacaatagttgaaagcatcacctcagttgaagccccaatgagacatctctgtgtaagattttggcatgtgttgcataacatgtttctaacatgcctgagggctaagaaattagctccatgcacccatccgtcacatttttgacatagaaatgcatgatctgcttgacaatacaatgttgccctcgagccacatagctcacaacaaacgaatcttgaggttgcattaggtgaaacagcctccttgttacaagaactgccttggttacttctctcctgattacctctacacatttctgggagctctctcagtatggaatggagagaaagaaggattgaaagaggggcgtctatatagcaacgc

SEQ ID NO: 17672 - DNA, 825 bp, Populus trichocarpa
  Predicted polypeptide sequence is orthologous to G1478, G1929
ttttttttttttttttttagcactacaccagaaaaacattactttggacaaaaaagaggtgataaaattagaaaatttccagagaaaaaaaaatacattttctgatttaatttgatctctttcagaggatttcatggagacaatgattccagggtatcctctatttcatcacccatttttctgtctgtgtttttctcctctcttccttttccaggattccaagcagctgctatggtctctgtattttcttggatatatatggtggtgcatataacagaaaaattgactgatcaattttatcacccacttgcaacaattctcatatgcacccaaaacccttcaagtgacagttttgtgttctctccatcaataaatctcaagaaaacaaatccttgaacagcaccagaaaactaaaaaaaaagggaagaaaaaaagggacagaaaaggtgaaaaagagaagcagaatcaaagaaacaaaaagggcattttaagtgatccagagctcttcttttcaagattagaattgcactgccttctttctctccaactcacaatagttggaagcaacacctcagttgaagcccctatgagatatctttgtgtaagattttggcatgtgttgcatagcatgcatctaacatgcctttgagccaggaaatttgctccatgcacccatttgtcacatttttgacataaaaatgcatcatctgcttgacaatataatgatgcccttgatccacacagctcacaacaaaccaatcttgaggttgccttagatgaaaccacctcttcgccacaagaaccgccttggttatttctctcctg

SEQ ID NO: 17673 - DNA, 873 bp, Populus trichocarpa
  Predicted polypeptide sequence is orthologous to G1480
ttttttttttttttttttaaaagataatggagttacataaggaaaagaggtaaatggggcttttgacctgaaaagcaaaatttcaagagcaaaagccttagctgcaacatgattaatattgttgcctataaaacgaagggctgcacttcaactgatccgttcaaggattcgtctaagatttacagattactgtaatcaacgttaaaagagggtaagaccaccttaccgttattgattatagctgacaaattacataatcttctagatagtaattaactggctagttaacctctcgctaaatccatgatcaaaacgagggaacgacaccgtattgggtatcggccatgaaagggacagagctcggagagttatataggttgtccatatcggattccatttcggttcgttttgcgaatcggcctttgattctcggtctggtttcagcgtaagcttttcgggaagcataccgtatggtcttttcgaactttcggttcttccttctctctctgtacctcaaaactctagcttcacggtcaatcccagctaattgagttgctgcttgattcgcagtccagcctgagaggggcatgcttggatcggtagtagtattcatgcttcggctgaaaggataggatatgtcggacatagaattcccatcaggaacaacaccaacatctagggaagacgaagaaacgctgtggctaagagactgagatgagtagctgaaagaagtgagtttagatctacagaaatcaatgtcaaagcaactttcatgattgatcaccggaagcggagctggtttggtttgcacaggcacaacgctatcagcaccagcaccagcaccaccatgaatcttctcatagctcgcatcaa

SEQ ID NO: 17674 - DNA, 854 bp, Populus trichocarpa
  Predicted polypeptide sequence is orthologous to G1480
ttttttttttttttttttactttagatagaaatccattctacttatatacaacaccactggtgggcaacaaagattacaacatcaatctcctatacaaaaggagatacaaaaaagacttcgaattattgttacaacaaggagggagtgatcaccaatgagcttgaagctcatcggaactcgccagtcttcttgctaagcaagaggagtgaggtcgacgaattcgaattagggaaagacaagtgaatttagaacgatggaacgacaccgaatccataaagactgcttcgatcaacctcgacttcagtatctgtacgtttagcgaaccttcctttgattcgtggccttgtttcggcataggcttttcttgatgcgtatcgaattgtcttctcgaattttctgttcttcctcttctctctgtacctcaacacccttgcttcacggtcaactgccgatagttgcactgtctggtttgctgactccattccgttgcacactgatctactacagtatgggttagatatgtctgtcaaggtacttccacttccatctggtaccactccaacatcaagagatgaagaagaaacactctggctcaaggagttatagccatagccaccaccaaaagacttagatccagtagagaaatccaactcatagcagcaatgatcattgaccaaagcaggagcttgaaatcctagtttgttactttgcacaggcaccaccccctcagtagtccctgaactgttctgctcttgcacttccacttttggatccacatacggatccaaatccaaatacggatccatttccgaaccaaacacatactgaccggtattcagatccatactatcca

SEQ ID NO: 17675 - DNA, 826 bp, Populus trichocarpa
  Predicted polypeptide sequence is orthologous to G1480
ttttttttttttttttttggagaccaagaccaaaaactttttactaacggagaaggaattacagaagccctgatagttaaaaagagaaggcaaatgggacttttgatctgaaaagcaaatttcaagagcaaaagcatagcagcagcgtcactaatctagctgcttagaaaacaaaaggctacacttcaactgatccatttaaggattcgtctaaactttacagatgacggtaatcaacgtcgggggggtgtaagaccaacttcttaccgttattatagctgacaaattacatattcttcttcatagtaattaatagctaattatcccctccctaatccacaatcaaatcaaaacgagggaacgacaccgtaatgagtatcggccaggaaagggacagagctcggagagttatatagggtgtccatatcggattccatttcggttcgcttcgcgaatcggcctttgattcttggcctggtttctgcgtaagctttacgtgaagcataccgtatggttttttcgaatttacggttctttcttttctctctgtacctcaaaactctagcttcgcggtcaatcccagctaactgagctgctgcttgatttgtagtggaacctgagatgggcatgcttggatcggtataagtattcatgcttcggccgaagggatacgaaatatcggacatagaattcccatcaggaacaacaccaacatcgagggaagacgaagaaacctgaaaaatcaaagaaactttttcagcaactctactaggcttatagttatttgagcttcaactacgcaggttttcgtacttacgctgtggct

SEQ ID NO: 17676 - DNA, 805 bp, Populus trichocarpa
  Predicted polypeptide sequence is orthologous to G1481
ttttttttttttttttggcataaagtaataatcaaatactaaattctgtacacaccatggagaaacctcttatgtacaaagtacaaactatgcaaatagtaaaagaaaaagaaagaaagaaagaaagcaagcttattttagcaacagaaaatgacataataattaattatgattcaaaaactatgacaaaacgtatggttattaattaatcgtaagaggaaagttagtagggactgaaatcgaaggctctgatctctactcaaatctgcagatcccaagaatagcagcagacgcgttttctccattcgtgaccatgtctctttgcaggctcttaatggtgtctaatgtctataacaacctttgatcttgaccctgcttaaccaacttcttcaacattaacacttgttcttgcttgcttccatggcctcaatgaactcaaagaattccctccatcattgctcaatattcgacctcctatattatgagaagaggaacatccaatttcatcatcagaatcaagatcaacattactctctcgcatccgtttcaagaatccatttctaccagcacaagaagtctcctcttcactactagaactagccacaggtggcacaggtgatggcgacgacgacgcagtaggacctgaccatggcaccacctggttgtctccatcgtcatcttcttcctcctcatcctcatcttcatcactgtcatcatcagtatgatcgtcgtcctcagattcttgatcattttcagactcatctaaatcatttcctcctccttgactttcttgatcactagtcat

SEQ ID NO: 17677 - DNA, 939 bp, Populus trichocarpa
  Predicted polypeptide sequence is orthologous to G1488
ttttttttttttttttttaacataaaggaattcactgcattactagctaataatttgattcagcatctatgggactatacttttctagtatacattggaaaatggaatttcggagttactgctactactggtaactaggtattaaagccagccattctcatctccattaccttcttgtgagaattcgagtgtaaatagctcacaaaagtaggactctttgctggcctatactctggcaatagcctgcctgacttgtatctcactccacatgcattacaaagtgtttttggacccagtggtcctgccctccattgtggggtcctttgtgctaggcaatgggtgcacctccttggttgctgctgtccattgttgctttccaaaacgcctaaactgtccttgctaccattactccctactacagctactacctttcctatgtcctcgtcgtgcactcccactcctgattcttcttgcacttcattatccatgtctgtgttgttgctgtcctcttttatgggcataatgagttcactgtcagctagccaatatgtttgctgaagcaaaggagggtctgagctggtcaaattattaaaggcttggttggtataacaccagctagttaatgggtttctggtcttgtcaccaggaagccttctcctcttgcttcttgactttcctgggattacaagtttcttcaaggaagatgggtcttcttggtcttggggtttccgttgccagttttttggggggttttcttctgtatttggcttttgagcttcaactgtgggtgctgggaggtagtttcctgtgctggacaagcagtcctctacaaatactgacagccattccgagctaaaatcaacttccgtgttttgagcagagaaagggtcatcaagaggactagtagtagctgtcaaagcagcagcagcagcacaagtt

SEQ ID NO: 17678 - DNA, 695 bp, Populus trichocarpa
  Predicted polypeptide sequence is orthologous to G1506
gagatgttgttgcaatgagtaatatagctggtgccaaaagatcacgtgacagccctagtcagaagttttcagaagtgaagttaatgaagagccccaaaaggattatcatgaaggctacgtatgagaacaaagaactcatagacaatgatggatcttgctttagtccaagaagcctatttgccctgcctactgatggtagctccctcatgctggattctctccattttgtggatgaaagttctgatcaggacctgctgctggacatcccatccaatggttcatttgcacaggcagagctcttttacccaactaatagttttggtcaacaggcaagcactagtagtagctcaatatacccgcacctaggccgcccctaacaaagtttgtccagttgattcttttaatcactagggccaaaaatagatgcaccttccgctgaatcaggtgactaggttacacatgttttgcatgccaaacccaacaagtctgtgaatgaggtttgatggttgctgttttttccttggatcattttgaacttggtatgctaagagatgacttttgggtgggtttttgtataggttgactacagattgttatatatggctgaaaagtgatagcagctggtgatttcaagagttttatatgcaattatagttgctgtattgcacattactttgaaaaaaaaaaaaaaaaaa

SEQ ID NO: 17679 - DNA, 907 bp, Populus trichocarpa
  Predicted polypeptide sequence is orthologous to G1512
ttttttttttttttttttacctgctaaaacggcatgtatttctagttaaatataaaaaatcggctcatatatattatctgatctaagatgttccataacctccgatccgttgctcttcacaaaatatacagatgaacaatggtgaataacctattactgtgtttcaaaatacaacaaggcataggagaaagcagcagaagagaaaaatcgagattctgttcaatgacttggctgccagcatctcatgccttcttatcctggggctgctagttcccgtcaagtgatatgagcttggaaatgcaccgaaaacccttgcataaaccatctcccttaacatcccaacaactggttcctgcaaaccagtcatcgtagggtctccaaggttaagtaatggtgatggggaagcctcttcgaaactgccatatggattagaattgtagttatggctctggtaaggattacgatatggaagccgctggctggtattagatgtgttcgacatgacaccttgagcaccacaagctgatggtctgggaggtatgatcatacccctatatggtgccttgccttcagcttcagttgagccttggccacggccatagagggggaccatggtagcgtgagatatatcagctttgcatactgggcattgcggatgttcatcagaggcaagggaggcgctctggacatggagccacttgtaaatgcagggccagcagtagaggtggccacagagggtgactactggctcatttgcaaaatcaaaacagatattacagtcaaaacagccactaaaactttcggagtcggctgctgcacttgaaactgatttccatccctgggcaaaatatcgctcaaagtccatggatctattctcgcgtccttctttaactctgaaaaggaaatt

SEQ ID NO: 17680 - DNA, 884 bp, Populus trichocarpa
  Predicted polypeptide sequence is orthologous to G1512
ttttttttttttttttttgtccctgcagtgtgtatgttcatcacctatatacaaaagctctaatatgagctagtcaaaacaagagaaggcacagaatgaagcagcaaaaaagaaagatggacactctgtttagagatttatcaagctgcatttcctgcctcctcatcctaggattgttatttaccatgagaggatttgtgtgagggtgggcaaacatattcgtgactgatgtaccaaaaatccttgagcaccccatctcgttgaacatccccatcattggattgaaaaaacctgtcattaccgtactccgaaggtttgatgaggtcatggccgcataacctccatgaggatcatggaagtattgttggtgttgaaacgactgagaatgtggattgaaagaatttgaatgaggctgccgactttgacgtgaagtatttggactcacagtattcaatcccgaagggagtggcctgcggggtaaggctgcatccaccgatgatcccatggattttgattctgatgagggtgggccgcggccataaaggggaaccaatgaagttggggaaatagcagccttgcagactgggcagcttggctgctgctgaacagcatcaggggaggaggttttaacatggagccatttgtacatgcatggccagcaatataggtgaccacagaaggtgacaacagggtcatgtgctgagtataagcatatattgcattcgaaaaggtcactgtcattgtctgagactgctgctggggctgggatggatttatatttctgctcgagtccaacaacttcctcagattcaaaatgtgcctcgtgatcaaagaagtgatgttccatatatatccacacgttctattacgtcgtaaacactgaa

SEQ ID NO: 17681 - DNA, 764 bp, Populus trichocarpa
  Predicted polypeptide sequence is orthologous to G1512
gagtccccttcgcaaaaatctctctgtctctctgttatctgcaaaatctccattaaagcttcctcgaatcctcttattttaatcaagccaaacaacacactgttattttgcctttaattgtttttcagagttaaaggagaacgtgagaatctatggaatttgagaaatatgttacccagggatggaaatcagtttcaagtgcggcaactgactcggaaaatcccagtggttgtttcgactgtaatatctgttttgactttgcacatgagccagtagtcaccctctgtggccacctctactgctggccctgcatctacaagtggctccacgtccagagcgcctcgcttgcctctgatgagcacccgcaatgcccagtttgcaaggctgatatatctcacaccaccatggttcccctctatggccgtggccaaggctcaaccgaagctgaaggcaagacaccatacaggggcatgatcattcctcccagaccttcagcttgtggtgctcaaggcgtggtgtcaaacacatctaacaccggccagcggcttccatatcgtaatccttaccggagccataactataatgctaatccatacggcagtttcgaagaggcttccccatcacccttgcttaatcttggagaccctacaatgaccggtttgcagcaaccagttgttgggatgttcagagagatggtgtatgcgagggttttcggtcccctttcaaactcgtatcacttaatgggtactggtagccctaggctg

SEQ ID NO: 17682 - DNA, 767 bp, Populus trichocarpa
  Predicted polypeptide sequence is orthologous to G1535
ttttttttttttttttttggagaaaaacagttcattcagtggcattaaattcgaaacagcataaaatttagaccggcaagcaggagtcaatacccgaaccaccacccttgctgactggtgaggccccatcttcataacaataatacactgagaaaggccttaccaggaagcaaaggtcacatcttggtgcgctcttgactcccctctattatccctctatttttttaattttacacagcccaatatctctgccatttatggcacaaccatcctctcatctcccataaaatctaccccactgaccgaattagcttcgcagtctcttgtttaccgaactaccactacttctactagcattacagtaatggtaacttatttgcaatcctagcctttactaattacctgaaatctcccctctgcaaacccaatagaaagggattagcaaaaaatgatcccttagtcctctttgtgaaatgtccaatgttgtaaccaccaaaatgcacaaggagtttctctgggagagagagatagaagaggggagactcaaggtaatttgcacggcgaaaaccctaaacttgttgtttgggtgcagctgtaggctcattgcaagaccctacagcattgccgttatcaaggcagctgctagtggtggtgttgttgttgctaagagcaacagtgatttggttcactgtgttgcacaaatggttgtttatcgcagtgacactggagaaattgagctttgcagatggaatagtgcttgcaagggc

SEQ ID NO: 17683 - DNA, 860 bp, Populus trichocarpa
  Predicted polypeptide sequence is orthologous to G1538, G1545
ttttttttttttttttttgctagtcaaaaggcaaagcattaaattaatatcggcatgcatttccaattactagctagcttgacagagagacctcgtgatacactagatgaagaagatgtttacattagattgttacttaatcactatctacattatcctaattatagtaatatcagttagctagccagttacatatacagattaatccattccatgccaggaatgtaattgttttctggtggcatgtagaaagcagcatcttcatatccttccattgcaaactctccaagaaatggggggtccatagccatcgacaaggatgaactaggactattagtggaaaccccatcaatacggtctgacagcctttggatctccttttctgcttcagagagttgttccttgagctttaaaacctcggattcaagctggcatttctcgacaactatgttttcatgggatgtcttcaactttgtgtactcctcctctagcttcttgttcttccaccttgccctccggttttgaaaccaaacggcaacttggcgaggatcgagtcccaactctgaagcaagcttgtctttcctctcagattccaacttatgttcattaccaaaattcatttcaaggagattaacttgctcctcattaagtttcctcttccttgccccactaagatcggcgtctttgttcttctttcgccttcgtcgtggtttagattcaccttgttgtggaaccatttgagtgaatacacctgggtacaattgagaggtgagtgccatgtgatcttcaagcttggtactcatggcagttgtcttcctattggttctcacgctccctctctctctcttttcttttctttt

SEQ ID NO: 17684 - DNA, 905 bp, Populus trichocarpa
  Predicted polypeptide sequence is orthologous to G1554
gttctcttattagtttcagagatttatcaaaacatcatcatcaagttttaatcttttttttagagaaaaaatgggttcgctttcatctgaattgagcttggattttgccaggccttcaacagcaaaagcattgccttttttgcctaaaacgatagccgattttctcaaggaggtttcggtgatcggtgattctgctgtgaaggttttgaaagtggatggttttattaaagatttagaagaggaaaagagaaagatcgatgcttttaaacgagagttacctctttgcatgctccttttgaatgatgcaattcaagttttgagggaggagctaatgcaacttggagcgtcaaaaaatcaacaaccagtattagaagaattcattccattgaagaaaaatattgatgatcatcatgaaaatgatggtttaattgaggagaaagactctaaagacaagaaaaactggatgagttctgttcaattatggaatgctgatgatcatcatccctctactgattacttgtttgatccaaaacaaaatctcaaattagaatctaagacaaataagaaaggaaatcagtatggaaacgaggatgcattccaggctggtataggcaggactgcagcacgaacgtttatgccatttaaagcctgctctggtttatcaagcaaggaggagaaattgccagttccttctctttctctttcaactcctgggattaagagcttaaaagaggaatccaactcgacaggttcaagaagcagctgtagtagatcagtctccactatttctggccctaattcagattcaaatttacgaaatggacctcaatcccagcagcagactgctaggaagcagaggagatgctggtcaccagagctgcaccgccggtttgtcaatgctttac

SEQ ID NO: 17685 - DNA, 926 bp, Populus trichocarpa
  Predicted polypeptide sequence is orthologous to G1560
ttttttttttttttttttcaatacattcttcatccaagttgatcagttggttttcatttagttcttgcatgttcatagccagattgacaaattctggaacttcaaactcagaaaaaccaccgaactcccgaggttcaattttaacaaatgttcctactccctcaccatggccaaattctccaacctcaacattattacgcccttgatcaatcggtcgccttttctttttactaatctcctcttcaagctctttcatcatgtccttttgttggactagttgctgcacaaaggtgggattttgcattgctctagccaagaaactcatcatatgttgctgtttattctcattccttttaactcgttgttccataagttgaaggcaagctctagtagtctgttgttgctgtctaagcttcactagttccaccattagtacttgtttgtctcggcttaatcgatcaacttccccatccagtctaaatgttccaacttcaacacaagcctctagagcttgctgagaagtctgagtttgaggagcttttctcctcctaacagtcttgagaagatgttttttccccctgagaaatccttcattagcaaactcccatctatctggatcaacctttctaaacccatatgtgtttagctgcctaacaaagcttgagaaattgttgtgcttgaagtatctagggaggagactaatggaaaaggcttggggatcccaaacaacaaagctgttgttacctctactccaagagataatatggtttgtgcttgaatcttctattatatcataagttttagtgagaaatggaggaggacctgggtcatggagtccctccattggttgtggaatagctgtagatgccatgcctgatgagtgtgtgcttgaactaccacctgcatactcctccttgatcgctcgg

SEQ ID NO: 17686 - DNA, 911 bp, Populus trichocarpa
  Predicted polypeptide sequence is orthologous to G1634, G2701
ttttttttttttttttttagctttgaaggaagcactgccatccagattcgattgaacctaaaccaaattcgcttttccatccacctatacaacaaagaaaggtgccctaatattgaatttgaaatcttgggggtggcaatttaaaaaccatgttatgggggttgatacgagccccatgatgagcaccgacacacagattttgcccctgaaattttagaccgttcgaacgtatctcatatggagatgacttaaacaagtcttcatgagttgaatcaaagaccataatcgatccatcctttgcttcgtcccagtcaatcaacactttctgcatccctgctggcttttgctgcgataaaagcaaatcagattgatctagcgaggaaggttcgtcaccatctgacggagtagtagcatctgcgagattgacagttgtaatgtcatggatgctaggtcttctcttatccttcactccggaaagctgctgccgtatgaaatacttctgtgcatggctcgccacttgagttggagtcttggaaactacaaaattgcgagagatgttcctccagtccccttttccatgctttagaagccccataaggaaccgcctgtgctcatcttctgtccatggcacacctttctttctctgctgatcagcactcttggcagtcaaagacctcttcctatacgcatcaaaattgctattgccaaccaactggaaagtgaaagacgagctaaggtaacccggaaccggaaccctccctgcttctatatcactaacatcctcttccagctccttgtattgcttgatcacatcataaactgtctttccaggtatcatagctgccacctttagccacctatcaggctcatgctcatcaaatatcgccaaagctatctcaaactccttgttc

SEQ ID NO: 17687 - DNA, 647 bp, Populus trichocarpa
  Predicted polypeptide sequence is orthologous to G1635
ttttttttttttttttttggtctggcctttagtagtttcattggttcctctgagctagtgttgctgcctttttattcacgcgcaaccttaaagaagaatttctgagcatggcttcgaatctgaactgcattctttgtgcctaaatgctcttcaatccgtctccaagcacggccgtaaagctttagagcatcaaggaacttcttatgctcttcctctgtccatctctctctttgtttcgtaattgtgtaaggtttcctcgccttgggagagtaatcactcccacaagagaactgctcctttagttggtggtcagttgccttctgtagtgtagcactcggtaaaattccattgcctgctgggagaaccagatttgatcgagtccctccacactgatcctgaatagccatatctgaaaaaaccactcaaaatacccttcttaaagaaactcttacagtacccttcttgatgatatcttcctcaaactcataaactaacataataacaccaaaaaatatatctctccactttcacttattctctgacacaaactaaaaacgcaacctgacccttcaaagcaatgaagtcaaagcttaatattctaacaaaaacctaaaaagattgaagcttttggcttctaccaagctaaa

SEQ ID NO: 17688 - DNA, 902 bp, Populus trichocarpa
  Predicted polypeptide sequence is orthologous to G1641
ttttttttttttttttttgctgaaaagaagccatggagccatgagccatgagccatggattaaaaaagaaaaaacatactctcatccatgggggtagtggtgcgctgatggcatctgaaaacccatggtttgctgtctaatgtaagagtcatgaacagctcctctaggcagattttggccttgcattttaagcccatatgagctaatcccataaggagcagacatgaacatatttgcatttgttgaattaaaagctaaggttcctccaccgttgggttgattccattgaaaatgtgttctaggcatggcagcagaattgggctgctgagaaatcgccccaggttgatcaggtgaaggtcttttattgtccggtgatggagttctcgcgtcgttgagattgacagttgttatatcatgaatactggctctcctcttatctttccctcctgaaagctgcctgataaaatacttctgcgcatgactagccacctgagtcggcgttctactgacaacaaaattgcgagatatgtttctccagtcccccttgccatacttcttcaagcccatcagaaacagcttgtgctcttcctctgtccatggaacacctttctttctctcctgatcagcaggtcgacctgttgaagatctctttccaccaaggccataagattgtttaaacccatcatagccattgccatcaacccaatccaatgtgaatggagaggtgctatatccaggaactggaatcagccctgcctctatgtagctaacatcaagttctaattccttgtactgctttatcacatcccctactgtcttccctggaatcatagctgccaccttgtgccatctatcaggagtgtcctcgtcataaactggaagagcattctcaaacgccttgt

SEQ ID NO: 17689 - DNA, 834 bp, Populus trichocarpa
  Predicted polypeptide sequence is orthologous to G1641
ttttttttttttttttttgctttttgtgagtacatgtgtgctcgtgtgtgagcgccatgcatgtgtgtcctatgagacgatcagaaaaatctccagacttgcaaaacacataaagatggtaacaatatgtgtgaataacataacaagtcctgcacccaaccctgatgaacagcattgatctgattcttgatattctttccattatttactgactcggtaggatatcactcactagatgatgatgactactcaggagtccctgctgcagctattagttaatattttaagaggtcataaaggagaaacatatcatcatgttccaatttgagaagttagtgtgttataatactgctacaacagtcatgactgtgttttcccaattcctcctcaaccttctataattaaattggaaaacttatacggatggttaatggaacgttgagcctgcaaatcataggagaagcattctccggcgttacattaagtagccaagtaacattcccaccttggagttcgttgtgttcttgttaccaggagcagaatacaagtttcccgaacaactctaattccatgtcatgtgtatatatgtgcagacacttgcgttgtgttttcctaccgaaatcaacttcaggccataaagaaatcaagctccaagaagtaatgtctcagtcctaagggacattaccgacatatttttacttcatatttcgctccacaaagtgaaattcaatttaaactctaaattagaagaattcaaaatccaagcttctaccatcgaaacagcttatctggaattgggtcctggaatgaaaagaaattctggtttaaaaagta

SEQ ID NO: 17690 - DNA, 753 bp, Populus trichocarpa
  Predicted polypeptide sequence is orthologous to G1645
ttttttttttttttttttcgttttttaccgaaaaccaaacttatctgatgcagctcctactccaagaaagtctatgaagggcatgttggttttctcattcctattttcattgtcaccacagcgagagggattggccctgttggtgccaactgactcagttgcagaatcttctgagtttgaatcagactggccagattggtccacacccctaaccaccccaataggcccattttgataaaacccatcttcacttccatagaacctgtcaaaatccactttctccattgtcacttccttatccaccgaagaaccccttcggccaccttgaggactgaacctggtgaaaagtctaggaggtactttggttgaagagggagtgagggagagatcagtgcatgttgagccagattcatcaatggtactagagatggttgttgattcactgcaagcattgttttgcaaagtgacatctagtgatcctgtagggaagatttgagcagacgacgagggctttctcctcctgtaaatgctggaattttctctatgttttctagccatgatcacatgccaatggttcttaacagcattatcagtccttccaggaaatagccttgcaatcatagcccatttgttgccataaagtctatgagcagctaagagtctctcctcttcctcttcagcaaatgctctcctgttaattctcggatctagctggttaaacaccttaatctacaactcttacctgatcttccc

SEQ ID NO: 17691 - DNA, 696 bp, Populus trichocarpa
  Predicted polypeptide sequence is orthologous to G1655
ttttttttttttttttttctacaataacatcaaggactaatattaatagaaaaaaagagacaaattaaaaatctttaaaaaaacaaaaaaaaataattataattgacacctggcataacgaacactctaatatatttgatttctcgctctcaacttgacaagccgccatcaactcccgcgccaccgcctacttcgccgccagcggcggtgagaatttcacttagagtggtcataaccttaatttgcatctccaaagccgcaatataatcactcgcttcctctaaaagattcacaaacgaaactttccggcaaccaggaactagccggctcaaaaccttcactttcttctccaccgccggtaacttcctcctcttctctctctcctgtaaccgacgatcaccgtttaatttctgtttcttcaccttcctcactctcaacaaccgcgcgcgtttcgcgagaatcgcgcggctccactgagttcttcctctagcagccaccgcgaggactctgttagcggtttctcggacttctcgagtcctcttcccaggatgagaagatgtccggcttgaccgacggagagcttcaagaagcttcgacgaatagatccgccgctctgcttcagttcgccacctcactgttagctggtttttgctgtcattttgaatgtgactctctgtcgtttcatgagtcaatttt

SEQ ID NO: 17692 - DNA, 882 bp, Populus trichocarpa
  Predicted polypeptide sequence is orthologous to G1655
ttttttttttttttttttaaagtaaggctaaaataataataataataataaagtgctatatacaataacatcatgaattaatattaatagaaggaaaaaaaaagaagacaaatttaaaatatttaagaaaaacaaagagcaaaaagatattaattataatggacacctggcttaactaacaatctctagtacatctgtctcgtcgctctcaacttgacgagccgccaccgcctcctccgccgccagcgacggtgagaatttcactaagattggtcataaccttaatttgcatctccaaagccgcaatataatcactcgcttcctctaaaagattcacaaacgagactttcctgcatccagggactaaccggctcaaaaccttcaccttcttctccaccggtggtaacttcctcctcttctcgctccccggtgacttgcgatcacgagccaccctctgtttcttcaccttcttcactctcaacaaccgcgcgcgtttcgctagaatcgcgcggctccaccgtgtttttcctcgcgctgccaccgcgaggactctgtcagcggtttcccggacttctcgagtcttctcaccccgatgagaagttatccggcatgatcgacgcagagcctctagaagcttcgacgaatagatccgactcgctgtgtcagttcgccacctcactgtaggctggtttttggtctcgccagtgccgtcgttttgaaggtgactctctgtcgtttcatgagtcagttttctgcgtttctttctttgctggtttggttcttgttgcgatgacacgtcacagtttgattggttgcttgccattaataatgtcgtccctctttctttatcgccttttgaagattgtgacaatagagttttga

SEQ ID NO: 17693 - DNA, 671 bp, Populus trichocarpa
  Predicted polypeptide sequence is orthologous to G1655
ttttttttttttttttttggccctttaaatgctctttttgaacaactatacaactatatttctttaaaaaaggaaagcaaagctcaaaaaataaaggaaaaaaataaaaaataaaaagtaataaaaaaaaatccatgtctacaataacatcaaggactaatattaatagaaaaaaagagacaaattaaaaatctttaaaaaaacaaaaaaaaattttataattgacacctggcataacgaacactctaatatatttgacttctcgctctcaacttgacaagccgccatcaactcccgcgccaccgcctacttcgccgccagcggcggcgagaatttcacttagagtggtcataaccttaatttgcatctccaaagccgcaatataatcactcgcttcctctaaaagattcacaaacgaaactttccggcaaccaggaactagccggctcaaaaccttcactttcttctccaccgccggtaacttcctcctcttctctctctcctgtaaccgacgatcactgtttaatttctgtttcttcaccttcctcactctcaacaaccgcgcgcgtttcgcgagaatctcgcggctccactgagttcttcctctagcagccaccgcgaggactctgttagcggtttctcggacttctcgagtcctcttcccaggatga

SEQ ID NO: 17694 - DNA, 636 bp, Populus trichocarpa
  Predicted polypeptide sequence is orthologous to G1718
gctcacactattcacaaaaaaatctaaatctcctctctctctctctctctctctccaaatctaactaccagtagcagttcgtcatggcctctgagactgaatttcctgccgagttttcttctatgtttgagaggcttttaaggcatagggacctctctttgttcttaccttttattttagggttcacctccaccaacaccacagagcaacgtgacccagatcaagaagcaccacaaacaacagacccaaatgaaagaatcatccttataaaccctttcactcaaggcatggtggtgattgaaggagccgcaagtcttgaatctttacttagagacataggtaacaagaagggccaaccaccagcctccaaagcatccatagaggccatgccaaaagtggagataggggaagataataaagatggtgagtgtgctatctgtttagaggagtgggagcttggtggcgtagtaaaggagatgccttgtaagcataggttccacggtggttgtgtagagaagtggttaaagattcatgggaattgccctgtttgtaggtacaagatgcctgttgacgaggaggaactggggaagaaaagagatgagggagatggagggagagagaggagagttgaaagag

SEQ ID NO: 17695 - DNA, 725 bp, Populus trichocarpa
  Predicted polypeptide sequence is orthologous to G1743
ttttttttttttttttttaaactatttagctgatgatgcaatatagaaagaaaaaaaaaagccatgatacactaacaatgaaccttcagcttaattagtctgtcacatgctcaagaattaacgatcacttcatgcttgagaagtttgcatcaatagcaacttgttaacgaacatgccatgatattctgaaggagggggagaaggtcattactcttgggcgaggtactaaaatcttgaagacttgattcatcgtagccaccatgtatcacgttcatcggtggatgtgaaagaacagaacttgaacgtcaatacttctgtttggtgctgatcaaggatcaatgttctccggggagtaagacttcctcggcaaagtgggcaagtcgattgccggaagtcaagcaatctgtataagcatgctctatgaaagatatgcccacatctcagctctctgatttcttcgccttcttcaacatcacttagacacacagcacattccgcaggagcttcattgatcaccgtgtttagttcttcaccaattgcaggcacagcaaacaattcgtgttcttggaagttgaacggatagtaacacaagaaattaaatgtccatctgagatggacactaatgatatttaggtacttgatgaacatgattgattgagtttagaggttaattttgttgcacaaacaaaaattagaaaaggagacaaggagttgggagagatgaa

SEQ ID NO: 17696 - DNA, 763 bp, Populus trichocarpa
  Predicted polypeptide sequence is orthologous to G1743
ttttttttttttttttttatgtcccgaaagtaaaacatttttttaaaaaaaattcttttatttgcttgaattgccaaatctccatgtatatatacacttcagacaacctcatcaagctctctaagaaaccgaaacatgactctattcatcgtaaaaatcactatcatcgctatttgcggcccataaccgctgattaaactccccctgcatctcatcaggcacaaacgaagtcctacagagtggacacgtgttcctgtcatgatccatccaacggtccaaacaagccctgtgaaaaatgtgcttacaattcttcaaccacctgatctcatcctctccttcaaactcatacaaacaaacagcacaactctccggcaagtcacaacaaccaccatctccgccgagcaagtcctcgaacttgatgacaggcaagatttcccggatcagggcagccgatagagacgggtagaaggacgttcgggtcgggtaatcgggccaaatattgtcagtctcaaggaaatctgagagacccacataggtaaaaagacacaaaacgaggccccggatgaaacccagcaaggaaagtgcgtgaacgaacagcttgggtaacaaaacctccgagtacccaactggaaaccccatttagctgaaaaaaagagaggaaaacagagaagaggattttctttctgatagataatgggagagagaagggtctttcttcaagaatttatagagagagaaggggagagagaagggaagcttctgc

SEQ ID NO: 17697 - DNA, 480 bp, Populus trichocarpa
  Predicted polypeptide sequence is orthologous to G1767
ttttttttttttttttttgaaatataatactacggatttctatatcatagctttgtacttggccaattttgaattagcagaggtactgcctccagagtcaaagggggccttccctatcacccacggacataaccatcttcggtccaaaagacagactcacacacttatttccttcccaccaacaaagcaatgatcaaatagaagctagctatagacatgcaaagcaatagcagcaacaacaacaacaatcagcctcagactagtcatacatcaacaagccgttcttcggactccggtgaggcttgtggggcaggaaacaaatgggcatcaaggcttcttagtgagtgtgcaagagcaatctcagagaaggactctagcaagatccataaccttctatggatgttaaatgagcttgcctctccttatggagattgtgaacagaaattggcatctcatttcttgcaagctctcttttgtaac

SEQ ID NO: 17698 - DNA, 514 bp, Populus trichocarpa
  Predicted polypeptide sequence is orthologous to G1789, G1911
gaatctcttcatggcttcaggttctagtaattggacttcaaagcaaaacaaactgttcgaaaatgccttggccatctatgatcaagaatctcctgatcgctggcacaatcttgccagggctgttggaaaaacagtggaggaagtgaagaagcattatcagatgcttgttgaagacgtccagcagattgaagctggtgaaatccctttgcccaactacactagaagatctggagctagcaacaagagctaccattgcaatgatgatcaagcacaaagggtgaagaatcttaatctcaactgaaggatacatgaactaagctagctatagaataaagatccattgcgctacaaatgacaataggcagaagcagcagcagtagcagcagtgttattagctagcaccgaaaatgggattacgatctctctttgttttatctgtttaattactttctcatcaaacattaattctcagttaatatctcttaatttcctgcttgcaaaaaaaaaaaaaaaa

SEQ ID NO: 17699 - DNA, 879 bp, Populus trichocarpa
  Predicted polypeptide sequence is orthologous to G1794
ttttttttttttttttttgataattgatcttttattttcttttaataacgaattacaccttcgccaacaggaaaaaatcgatggtaacatagaaacacgggtatcctaccaaagtaggtggaaaaagttgtgtcgaagaaaaataaaagctgagatgtatgggctatccagaagacgaagtatagtaatggctataatctgaccacgctggcaactgaaattcttccccaccactttggctactagtggcaggcataatctcgcctggttgctgagctggtaaaaacataggatcggaatactctgttgaagaagacatcgaaggataagacgaaacaagtggaggtgacagaaacatttggtcgtatagactcatgggttgcctttgatagccaccaacacctaagatcaattgaggttggttcacctgctctcttgaaatctcacggttctgcgtatggtgaagagcttgggaatgaactatggcctcggtggatgtaggaacggacagaaggccggtgctactcggagaatcagagacggtcaactggtttgctattggatttgggggagtcggtcgtagcttgacgttttctgggaagtttagtttggccttgttgcctctaaatctgagagcggcttcatcataggctcttgctgcagcctcagctgtgtcgaaagtgcctaaccaaactctacatgccttgaatggatcccttatttcagcagcccacttgccccatggcctttgcctcactcccctgtattttctcctcggctgtctctgcaggtttcattatattcatatacgggggtgaatgccatccgtgtggctgcaggtgtcatggtgatgatggattttcctgaggctcttccagc

SEQ ID NO: 17700 - DNA, 843 bp, Populus trichocarpa
  Predicted polypeptide sequence is orthologous to G1798
ttttttttttttttttttgccctattaaaagagactagactacaccaaaaccaaaaccctgattacaaaccaccaaaaaccaaaattataagcattagaatgaactaaaatgaaaacaagcacaactcatgagtttataaaagaatagggctcaaggctcaaggctcaaggctgctcaaatacatatatattaaaaaatatcacttctaatataatagtatttgagctgctatccaatacccctaccattgcaagtcctatttgctctctgacaataccctttatcgcttccaacaacatctggatcaccatctctcaaagcaaatctttattttcaaaatttgcatgaattgcctaagagccgagcactgatgttcatcataggtgcctaatagtaatagcacctaaacttccttcgccaaaccacgtgcattgttggaagtatccacttatgatgcatggtctccttcatggcccttctcattgttgatcttctcacataatgcttgaactatcacttcaagcgaactcttgtcatgttctagttgtgcattcttctcttgaagctggagtttatccaaattgttttggtcattaacttgactccttaacagaacaattttacttttgagctgtgtattttcacgctgaagatcagtatcgttggcaccagctagtcgctttgaaagaacctccacaacagtattttgtttatcatgcttctccttcagtagaacaattgttttcctgagtcgcttcatctcttgttcttgagattgcaaagtttgtctagtccgaactgcttctgttttaaaggaggcattctctccttttaatcgatcg

SEQ ID NO: 17701 - DNA, 875 bp, Populus trichocarpa
  Predicted polypeptide sequence is orthologous to G1835
gtctccctcttcttcattccctctctccgttttaaaactcaaacacatatcacacattcctcgtcgctcccactgtcctctctctttctctaaggtgtttaaaattacaaactcccaaaaaccccaacaagaaattcgaattaccaagaattcccttctcttctgtcaaggaaggaataaaaagttaaagaagcgaagagaagagaaaatgattggacagacaaatactactagtaatttcatggacgagatagattgtggaagctttttcgagcacatcgacgacctcctcgaattcccttctgatgatgtcgacgctactttacctgactgcaccaccacaaacaaccataccagttgtttcatgaacaacgatgataactcgtttcctggtatttggtcgactcagtccgactcgctcccgggttctgcctctgacctatctgccgagttgtccgttccttatgaagatattgttcaactggaatggctatcaaactttgtggaggattccttctctggaggaagcctgacgatgaagaaagaggagtccacaatcgtcaacaacaaggaatcgccgccacatcaccagtaccagttccagacttccagcccagtttctgtccttgagagcagtagctcctgctcaggagagaaaactgcaccgcgtagccctgaagttggtgcttctggcaaacgtgggcgtgctcgtagcaagcgtcctcgccctgctacattcactcctcgtccagcaatgcaactcatttcacccacttcgtcaatcactgaggttccccaggcattcgttccacctaagatcgctttggactctgagaactttgctgagtccagacttgtgatcaagataccgaacc

SEQ ID NO: 17702 - DNA, 857 bp, Populus trichocarpa
  Predicted polypeptide sequence is orthologous to G1835
ttttttttttttttttttgctccattaaaatactcgtctcaggattttttactaacaaattgctctgaaaaaagaatactcatggcaaaagaaaacagggaaaagaatgcaaaagagaaacgaacagagactctttatacctagttaccttaattaagaacctacccttgactgactctaaaactctactatcccttaagcttccattatgctctaacccttttctgagctcttccttacagtgcttctctattagctaaaattgtggtcatctagtgctatttcccccattccatccctgtacaaaatccaatgaacaaagaaatgaaataacagtgagcgagcagcatgacagtgaatttagggggccggcaaagtgaaatgatccaacaggaacactgttccctacatcctccctcacatgtaatccattgcagggttgctctcatttggaataaactctggcgagttgaccatcattgtagcaggtctgctggtagtaattttctccccagcctttgctctcatctcaacaactttcttatgcgaattagagtgcagggaaggaacaaaggttggactggctgcaggccggtactcggggaaaagccggcccgacttgtatcgaacaccgcaggcattgcaaagggtttttggacccattggtcctgctctccactgtggggtcttggttatctcacaatgcatgcatttcctaactgcttgctgtggctgtgagttttgattcatctccacagtacctgacggaacaataaacttaattttcttcttcttcttgtgttctgggtcaacatgctctggtatcttgatcacaagtcttgactcggcaaagctct

SEQ ID NO: 17703 - DNA, 665 bp, Populus trichocarpa
  Predicted polypeptide sequence is orthologous to G1855
catattctcttaccttgacctatttccaactattctctatgacgataatatagtatgagaagaaacacgggggggtaaatttatcttcgttaacatggaggaaaagcctatccgttttctcatccacaaggatatatagtccttgacaaataatccgattcaacatgatggtcaccaaaaaagaaaggaaaagatagaaaggaaatgaaaaggggtttctggaagagtaagaaattacactactatggctactccttttgtttttgcttcttttcaccagtccagtaagttttgacagcaacaagaattttctctgggttaaaaggtccactttcatggtccataatttggctcttccacctcatgccatttgttatggtctgaatcctcacaagaacctctactgtatccctgaatatcactgtcccttctggcctcagaattctatccatctccagcagaatgtgggttatgtcacacctgtcctgatatatactaaacaccccaccaccatggatgagatcgtatgttcttggatatgttgagactgcctcacaccaatcttgatatgttccaatgaaacctcgttcatagatcacaccaagtgtgtctggatttgaattggcaggaaccacattcctaacccacactggatattttgccaa

SEQ ID NO: 17704 - DNA, 855 bp, Populus trichocarpa
  Predicted polypeptide sequence is orthologous to G1863
ttttttttttttttttttcagtaacgttaggggacagatttcacagaatgacagaggtaactggatctttcaatgctctcccgagcaatctgtggcaaaaggcaggcttttttttggtggtccagactttcttaagcataactgatgcctctgagcacgtcccagttaagcttgttcgctagtatcattgctagccaccagattcaggtgcttcaagacaaatcttccatttgacagccagtaggaaaacagaagcaaacttgaatttgtttggcagaagacacttttatatgcctatgtgaatatagcaacatcatccaatttacttccagcaaatgcagccagaaaggcagaaacaataataaccattcaaccaaagagcagacagcaaccgagactacatggagtacacggacttgaagccaaaacaagatcagaccatattgggacccgtggaagaaagcagcaatccaggacattcttaattgctggttaaggaaccaatctgtggcaaaaagaaggcttttaatgagcactattcctacagaatcagacactcaacaagcaagaaaagtgaaattatctgctgggatgcataattggagaaatattgagatatataggtgcttgtgacgaagctttgttgtgtggacacatttttttataagaaaactctagatgcatgtccataatacaagtttaaaatccattgtactcaaacaaagaaggcaggaaaacagttatcaacaagataatcaaaaagaaggggcggaaaagttatttcattcatcgactgaaaacataagttactcctgctacatgttggtctaacaaaagaaatggtctcccttcacc

SEQ ID NO: 17705 - DNA, 783 bp, Populus trichocarpa
  Predicted polypeptide sequence is orthologous to G1868
ttttttttttttttttttcaggagaaaaattactttaattcacacgttaaagatccctacagatccatatgtgcaagaatggccgatacctactcaatcgggaatcagccaagtctttacattctagatttgagggggggaaacaagcaacaaggagaaacagtctgcagaaattaataagataaataactccaagcttcttcttcacaagtttcatcctaaccattttcttgattacagggatggaataggggatcacttgcaattatcgaaccaacaacatcctcatacagactagcactttcattgtttttcttgctctctgctcttgggctgctacctgaactgctatttgaaagtgaaccaaaagtcgatttctgcaagactcctgttggagaagatcccagctgcgggctgccatcccaaccctctcttaaaaggttaagagctgatgagcttttgcaggaatccgcatggctggcgctggtggtcaagacctctcctaaagggccgccaattgaagttccccaagagataggtatccagttggcttgcttctggcttgattcattatggtcaccgctcacccttaaacccatttgtatagggtcaaactcgcgagataacctcaatggtgagaaggcaagtttctctcgcagaagtgaggatgatgacgacgagaagtctgacgagaccattgagattgacattgagagctgggtacagtcagattttcactcttctggccagctaatgacagaacgatttgattggtccttcggc

SEQ ID NO: 17706 - DNA, 838 bp, Populus trichocarpa
  Predicted polypeptide sequence is orthologous to G1868
gcccagctatgtccaaaccctcctcttcaatctcccattctaagggttgcttaataaagcagtagaagcagccggtcatacccaagtgaagttgaagagagaagtgaaagaaatgagcaactcatcagtcacagtggcgggggtgggatcaagatcaccaccaggtttcacgatgtctcagtggcatgagctggagcatcaagttcttatctttaagtgtttaaatgcagggttacctgtccctccttcccttctccttcctattcgtaagagttttcagcttctttcccctggtttcttgcacccatcaaatttgagctactgttcctattttgggaagaagattgactcagagccagggaggtgtcggaggacagatggcaagaaatggaggtgctccaaagatgctcacccagactccaagtactgtgagcggcatatgaatagaagccgtaaccgttcaagaaagcctgtggaatcacaaactacctctcagtccttgtcaactgtggcatcagaaattgcaactgggagcagcagcattgggagcagagggtatccaactaatcctgggaccttaggtttgggaagtaatatgtcacgttggcagatggagtctatgccttatggtgttaatagtaaagactacaggtctctccatggaccgaagcctgaagcagatgagaaaactttccctacagaagctttggggaatacaagaagctttggaatgaactctactgtggacagcacttggcatctcacatcccaagtccctggcaaccctgtgccagaaatcagaaatggttctctttttgcaaactacccacaagtacag

SEQ ID NO: 17707 - DNA, 868 bp, Populus trichocarpa
  Predicted polypeptide sequence is orthologous to G1868
ttttttttttttttttttgatatgaagaatggagtttctttagacttaagatccatgttggatcgaagcatggacaaggctgtcgcatcctgcgttctctcacctacattctctttagtaaggaacatcctgctgagcgtattagaggcagaaagattagatggactagctgcttgctgctgattatgagcaatagtgaggctgtcggacacagtgctgcgaagccccaccactgatgatgatgtagaagacgaagtgccattggctggctttacagtggtggcggctgcagcggaatggcctgattggccttccacaggctttcttgaacgatggcggcccctgttcatatgccgctcacaatacttctgatcggcaactgcatctcttgagcaccgccatttctttccatctgtccttcgacaccgtcctggctccggatcagtgttgctggagaaacccatatggaaagcaccccatggcaatgtattgggcctgaaaaatccagcagaaaagctaggaaacccagcagaatcaagagcttttctaatgggaaggagcagattagatggtataggcacatttgctgctatatacttgtagatcaaggcctgatgttcaagctccatccattgtgattgagtgaatggccatctggtctcggtcaaaaccccatgcatgctggcagcattgtagataccagagctgtagcctgtatttctattatgagcagaagatgtgaggtgaaagtacggcaatgtgccattttgggagcttctctccgctgaaggagctgatctgggataggagaagctgagcatctgctgctgctgctgctgtccatcagcgaagagaaagttggagctag

SEQ ID NO: 17708 - DNA, 913 bp, Populus trichocarpa
  Predicted polypeptide sequence is orthologous to G1880
ttttttttttttttttcaggttacaacagacaatttaaatgaacaaatatatataaaaacaaaacaaagagagaaggtttgcttaatactgtttgcatgaaatttttggggtatcactccccgtccccttcagtagttgctgaggacatgtaactcatagcaagggaggtttcgtctgccgatgcagcagccgttgatagtttgaattgtagcttgcaagcttggcaggtgacttgcataatggtagagctaatcttctttgtagcttgctctctcaaaacttgagccttttcaagctcagcttgagcttgttgccttatcctcttcgcatttgcaaattccagttcagccatctcaatttgtctctttgcatgttgtctagcctcctcagcataggccttttcagttatagccaacctcaactgttcattagcaaactcctctaactttgctgcttctagtgtaggttcataagttcttttcgggccacttggatccataatggccttgaattgttcgtttttttttaaactatcacttgaccctattgaaagcttcaaatttgtagcataaccctcgtcaggattttgtgggaagtgagtgcttgaagatggtaggagctgaagttcaagattgtgttcttgctgactagtagatgcatcatttctatccgagtaaaagtaaactggttcggttgcctttgacattggtatccctggtaacggaactatgctaaaattggcatcacttgaagggctggtgcttgaggcggttctggatgagcaggccgccggctgcaatgcctgtagttcaggctgggctcgccttactgtgcaagcatcttggtgctcgatgaaactctccaccctggaaaatacacggccacagtcacaagaatgacctcttgtacaca

SEQ ID NO: 17709 - DNA, 863 bp, Populus trichocarpa
  Predicted polypeptide sequence is orthologous to G1893
ttttttttttttttttttcttttttttttttttttttttttttttttttttaattaacaaggcttgacttgcaagcccttatcaaaacttaatttgctcttaactccatttgaaaaaagaaaaaaaataataaaacttcacttgtttagtttcttccttgtaaggggggggatttacacaacttggtctaacatagtcatggaacctaattaacattatgcctaaaaatacaccggcgagaaaaaccggggaactaaacaaattaatgcacccatgaaaaattaatggaagctaacaagaatatgtccatatgaagggggggaaattcaccgaaaaccctattgatgatcacatacaggattccccatcatgttcagtactttcaaatgctagttcatcctcttcttcaaagcaatcaatgccaacatggccatggccaaaggccttaatggggtcttttagagacctcttgggcttaaaatcagacccacaaatgcaataccatattttcccacagttcttttcatgtgttctccaatctcctttcacagcaaatggcttaccacattttctacacataaagggtttgatcccatgctttctcttgtaatgtgtttggagagttctaaaatctttgagcggtcttgcacttggatgatcaatgttgtgcttgcaacctgttgcacaacaataacatggaagtcttagcatcgctgttggctgggttcctcttaaagagtcaggtccttttctgtactgagatccatgtccccacatatgcatctgcaagttgttgtatctgttaaaggtcttggagcaaagaggacatgaaaattgacttggaccaataagaatctgggaag

SEQ ID NO: 17710 - DNA, 352 bp, Populus trichocarpa
  Predicted polypeptide sequence is orthologous to G1893
ttttttttttttttttttgggtctttgtctttgtctttgcttctttcttcgaactcaaaattaaaatgagtcacacttgtactaaatttatctactgactaatggcggaggatgttacatcataagacagacagactagtagcagtatactaacagtggtaatgcaatgaaattaagaaagagattaaataattaaggactggagtttatttatgggagaatatggtaatgctgatggtgcagattcagtacagagaagggatgtaacagatggaggggaggatgcctaagcctagagtaacaaccaggggcaaggaagggggaaaggagaaggggcgctttcacaagagac

SEQ ID NO: 17711 - DNA, 671 bp, Populus trichocarpa
  Predicted polypeptide sequence is orthologous to G1928
ttttttttttttttttttagacccttaatctagtttaatattgtataataaaataaacaacttcaacttaaacagaaaaaaaggttcaaaacccgaggtaaaactgtggagcactatttagtactgttcatacaaatttatggatgccatagaaatatttggctttggacattctctatctctctaagaaggagaaaaaaaggagcaagtgatatgacatatcgacccgtaaattgctaaccttgccaaggtggtggtagattttggttcctttgcccatatgttgaagggttaatgtgatcgagccagtctttgtgaggaaatgctttgagacccaagaaatctcttgtcaagtcatcattgccacctccatgaggactaccaacagcagaagttctaacgtcatgatcactcctcctaaattgagattctgttgactttgagagtatttcctgaaaattaccactgtctctttttggattcaacattccattgaaatcctcattatcaaaggatgaaccatcaaacccactcgcagaagataaagaactcatcatatcatggactaaagaaggccctcctgcatcactcgcagcaagatgttccatgataccagatgtgacagcagcagctttattctctaaagataccagcccatggccaaacccacc

SEQ ID NO: 17712 - DNA, 705 bp, Populus trichocarpa
  Predicted polypeptide sequence is orthologous to G1928
gaaatttcaatgaattaataataacaaatatgaatgaaccgactagatagttatgtataggtaaattggcaggtatacattcgcatacacaatgtctaaagtctaaaagtactacaaatccacatctcaatcaatttgctaccaccaaaaccaaaatccaaacccaaaaccaatatttatacatattgaaactcatcgaatccgttttcattttatatttttttatttttttcttatttttcttctttttgtcgcgcatcaatccgttcatttgaatgcatttggggaaacattgaacgaatagagcggctttgaaacctcaaatgcaaatacaaatacaaatacaaattcaaatcaatgtgatcacacacccgccaatacacgatcaatcaatcaatcatgaatttgcatgcaaacgcttttaattcaaacacacaaacacacacacaaacacacacacacacacatgcagatagagagatgcaaatgccagacgagattcaattaattattatttttaaatatctaaaaacggaaatgaaattcatccgaagcagctgatttatatggaatacagagtgcacagcgtctatcaattcaatgtcaaatgggctcaaatcaaacaacacatccgaaattcaaaataacatattaaaccaaccactaaaatttacgaaatgaaaaattaaaaaaaaaaaaaaaaaa

SEQ ID NO: 17713 - DNA, 868 bp, Populus trichocarpa
  Predicted polypeptide sequence is orthologous to G1928
ttttttttttttttttttgccacttccacctcttgtttcaaccacttccagttcacctcattcactccaaaaagttcatttcgaacactaaacatactgtgaatgataattttggtttatggtggtgatttggatgtgtatttatgatgaaattgttgggtttggataaactttgaaattgagggtgtacataaacatttgaattgcttgtgtttattttttagtatgatgttttttttgtggataaacatatattgcaatgtgttttccagtttttggtttttgtgcatctaggccaaatccttcaaaacttgcatcttgctcatgtttaatgttctagatcctatttcaaatagatgaacccgtgaccgacactatttggataggaccggggcatacaatcttcattcatttagaaaatattgcgagtaaatcttggatataggataaataaaccttaacaagacattatctatagactcttcctagaatttgagttgggttcaatgagtccaacataagcccattggttatgtattagctcgacttgacaaacaattagcacaagttacgatcaagagtcaccagctatagacatgtcaattaaccaagtattatcaaaatacaataactagaagttgccaaagatgaaccataccatataatggttaggcttaaaccaatcttccaaggtttaactaaatgtagtgggcccactatcacccataaataagactactgatagattaggcataacaggctgttatgaataaatgacaagagtagcaatgcaacttatttcaagtagaatgttatagggtgatagtatcttcactttaacataactagtctcttactttggaactct

SEQ ID NO: 17714 - DNA, 563 bp, Populus trichocarpa
  Predicted polypeptide sequence is orthologous to G1928
tttttttttttttttttagaagtatctttagatttgacaacaatggttttccaaatggaacaacttaacaattgagacttgagattttcaatcgaaggtctcccgttcaaaccttggaattggaacaagtgaggtgggaattaaaaagttgtgaaagtagcactactttttattgtatagctgaaagtccatggagcttccttgccaaggtggtggcagattttggttcctttgcccgtatgttgaagggctaatgtgatcaaacccagctggtagatttagaaagtctttgtggggaaaggctttaagacccaagaaatctcttgtcaagccgtcattgccgcctccatgatgactaccagatgcagcatcactccttataaatcgggactctgttgacttggagagaatttcctgaaaattactactgtctctttttggattcaacattccattgaaatcctcgttgtcaaaagatgaaccatcaaatccactcgcagaagacaaagaactcatcatatcatggactagagaagtccctcctccatcacttgcagcaagac

SEQ ID NO: 17715 - DNA, 887 bp, Populus trichocarpa
  Predicted polypeptide sequence is orthologous to G1932
ttttttttttttttttttggacggacgaaaagaagttactttccattaaaactaagaaaacattatatatatacaaacaagtccttcatgattcttagtttataaatattttgttgttaataatactcccttttcttgccttaatacaaggtgtagatagcgaagcagacggtgcaataggaaggggaaaaaaaaaaaaagaggagaaaaaaaaggaaaataagagatagtggtaaggttaataataaaaaccagccgcaagatatgccttaaaagaacaaaaagagacagaccgtcttcttcttcttctccatcgtcatcatcagttaattgttactattaatattcagtcacagccacaaaggtggaggctcgttcaaatctattggcaacccacgtcgcaccatccccaaaaacgaagccggagcaacattttccggcaccggagctccagctacagcaccaacaccaggaccctctattttcactactggcccagaagctgctgcagcctcagtagcattgaagttcatttctttaaaaaccactccagtctgcaagaactcaccaagaccaccaaacctgtgggacccgacatgaggacttgaaccccaacgaaggtggtggtggtgagggtcggatggaagattaaggtccagagagagaccagaagtggaaggtggtgatgggaagttagtctttgccttagctccacgaagagaacgagctgcaccatcataagcgagagcagcttcttcaggtgtatcaaatgtgcctagccatacccgtgttttcttccatgggtcacgtatttctgcagcatagcgaccccatggtctctttcgaactcccctgtagtgtccttccctttgaagaagcatgaaagg

SEQ ID NO: 17716 - DNA, 832 bp, Populus trichocarpa
  Predicted polypeptide sequence is orthologous to G1938
ttttttttttttttttttggacaaaagtatgactatgaaactctatgtttcatatcacaaacaaactgatcaaattcaaccacttcatccagacctacagaagaacaaaataattaaagatgccttacactataatcaacacacctctgaatcaaataagaagttaagcccaaaaccaagctatttggctgtgcacaatcccatctgtatatgaaaacctgagtgaggcagtggagaagaagtgaatggcaaaccaaatccagtccctattgaattctcccaaagtatctctctttttttttgctcgcattttttttttctgtttatcaattatacaacacaaaaaaccattaacgaaaatcactcagcctctctttcaacatcaacaaaatgcctatttccttcaactactaatcactggcctgatccttgtgaatcatctttagaaggattttgttgctgatgctgctgctggtgcactctagcatgccccatctgctgataaatctgattcaaagcttgtggactcaaaaccccaatatggccgtcctgtgacaacccaagttccaatcctggtaactgctgggtacccccacctaaaattgaagtaaaactcataggccccatgttgttacccggcaagtcaaaccctggaaacccgagtttttgcaaataactagaaccaccagcagcagcagcttcagtccctatatttgttgttgatggaccagtggaattagatgatgactggaacccataacctccaactgggggccataatcctgcagtagtaacatgatggggtctccctaaattgccacctaacattgcc

SEQ ID NO: 17717 - DNA, 617 bp, Populus trichocarpa
  Predicted polypeptide sequence is orthologous to G1946
ttttttttttttttttttgatgctttatcatactatggacttaaggatagcataatgtttcttgaggtctagaacctctcacaagatgtataggggaaacgttcaaattttaaaaaaagaagaaaaaaaataaagaaaaaagaaaagaagagaactttaggtctccacatgtgcaaaaataaaaactattgttggaacaggaacgaaaagcatcgagttgttgttccaatggccaaaggagtaggaccatctgattaaggttaaaagtttatctaggtatttaaatattacggtttgaaagaaaggtacatttggtgtgcgaggttaaagctgcttgcgatctgatgagagaagtcccatttgttctgtcagctgatccatatgctgagctttgtcccacccgtttataatttgatgtacatcatttccattggctttaccctccacagaacttgattcaatatcctcaggcactggactctgtgcaagaaggtcatcccagaagctagaattatcaagcaaagcatcgatatcaggatcaggggagatgttgtcaatatctatgggtattgtatcattaattccaagtgaaactggatctaggaacacatcactgc

SEQ ID NO: 17718 - DNA, 760 bp, Populus trichocarpa
  Predicted polypeptide sequence is orthologous to G1946
ttttttttttttttttttggcttctgttatgcgcctgttgctttcattttgctgctgtacaaactgagccaggaagcccgggctctgcatagcctttgccaggaatgacatcatctgttgctgacgctgctccatcccttgaagtcgctgcaccatggtttgcaactggctatccgtggactgttgctgctgcctcaacctaacaagttcttgcataagaacattcttgtccctcttaagcctctctacctcttcctcaagcccaaattttccaacctcaacacaagcgccaacagttgagttctgtccacgagcttgttgcggctgttgattagtatgtccatgggcaggttttcgccgactgatagtcctaagcaggtgcttctgacccctcaaaaatccttcattggcgaattcccaacggtctggatccacctttcgaaaaccgtatgtattaagttgcctaacaaagctggagaagttattatgcttaaaatacttcggcaaaagatcgcgagcgaactccggcggattccaaaccacaaaactattattcgtcgaactccaagacaccacggcgtcggtctccgggtcgtctaccatgtcgtaagtcttactcagaaatggcggcggagaatttgactgggacgccatcggcaccggcgccgcttgtgctacaccgccgctagtagaggcgtcgccaccgcttgcagtggtgtttattccatccatcagagtaacgtgaatgcttgctgactgg

SEQ ID NO: 17719 - DNA, 333 bp, Populus trichocarpa
  Predicted polypeptide sequence is orthologous to G1965
tttttttttttttttctttgggccacaaattaattaatgcataaactactggagcctcttaattaagtaaagaaaactacaagaaagatggggggggggggggggctttaattctcttacttcattgatttaacctcaaaacttgaccaattgccaaaaaacgggaaaaataggtaggcttgattcaaaaataaccattgaaaaaacgggggtcttgatcttgagtggcacttgaaaaaaaaaaaggcaaacggaatttcctgaaacctcaaaaacctttaatgctgcgtcttgggggcatcaatctctctgaaattcttgccaaaccccccg

SEQ ID NO: 17720 - DNA, 885 bp, Populus trichocarpa
  Predicted polypeptide sequence is orthologous to G1983
ttttttttttttttttttaaaaggaaattaatcaaaaacttaaaagagaaagcaataataacagcaatttacaccaaatccacacacacacacatatttataaagctccatatgtacggctggtgctgctggcctgacttgtatgtacacatgatccaattaatcatctccatctgatccattcccatcatcatcagctccatctgctctacattaagagctcattaacccatccaaggtcaggatcagaagtacaagccaaaccaccatcaccaatattattatgatcattaatcttgtcatcaacgaacaggcccttattgcttgaacaatctccattgaaaaattttgatgaaggggttggagttgaaggtgaaagaatgaattgtggctgatcttctccactgaaagagacatcaatattccatggagtggtgctgttgacattcctgttgtgattagtagataaggacataggtgaagaaacactcgctccttcgttgaaattcatggcttctaaagaactcattagctcactgagcacatctttgtaactcacaactccagccctaaacttgctcagcgtttcattatatcgggagattggcgaaaacccggataaggattggtgtttcaccggtgatagaggtggtgataatgatggtgacaatggcggtgacatgtgggacataccaaggagagtagaggtcggagaggaagtcatagaatggcaaacaacacaacaatgactatgattgagagatgaacatggtgaagccaagctcttattgcgtgaagaaacctcaggcaaaatgcgaagttggcgaggggagtgagcgaagaaacaaacctttcgcttacaattcttgccatctttgcaagcct

SEQ ID NO: 17721 - DNA, 751 bp, Populus trichocarpa
  Predicted polypeptide sequence is orthologous to G2010, G2347
ttttttttttttttttttttaaaacaaaaaacaaaaacaaaaccaatgtttttcccttaaaaaaaactttatgaaccccccccgttcggggaaaaccttaaaaccccatattacacaaatttttcgaggcctaacccccaaaaaacaccccctatcaaacagcatccctactaaaaaaagctaaagcccccctaaaacaaaaaacccccctaaagggttcactttttatagggccccaaacaggggaaaaaaaagctaaaatttgacaaaaaaaagggaccaggcccctggtatggtcttatctgatcggggatcccttggaaaaagaacttccttgggaggggaggcccatctgaaatcttcctctttcatcagcttgccggcacgggttttttttcatttgaaaaccaacccctttgctgctcgaaccttccccaaaaaattcacccgggttcttccggcccccctcattgggtcctgccaaacccctacggcaacccccctttgtttcatcaaactccagtaactcagggaacctgctgcattgctgaaaaaacccctgcctgaggccaacaacaaccacaggtggggatttcccatgaaccccccaaaccttgggtcccctggggtaccttttaacatcagccaagttagctccacacttctctacttggaaagacgggggaaaagctccgccgccaccagtccctctcttcccaactccttttttcttttcatcatcggaaaaacc

SEQ ID NO: 17722 - DNA, 955 bp, Populus trichocarpa
  Predicted polypeptide sequence is orthologous to G2010, G2347
ttttttttttttttttttgtgataactgataatatattgattgaagcaaaacactcaatacaagtcaagtcagtgcctgcaacaataccctgaaactattagaataagttgggttaagttaagtagctaagccacactggtagcatatgcctagtgccacagctagcaaacctgacaccatgcatggttgtcacacaatgtgacattagcatttgtttagccggagaagtacataataataataataataataataataataagaagaagaagaagaagaagggaaagagtatcagcatcactacatccctaggatgacagaagagagagagcaatcggtttagcttatctggaaatgtttgtaagtggcattttcttggattgttatcttaattcttcccctttcatcagcctgtccacataccatatccttcaactgggtgccatgagttccattcactttgcggcttgagccttccacgtgagattcaataacattcttccttcgcctctcattgtgtccggccaaccgcctgcgacagcttcttttggtttcatcaaattctgatagttcatggaatctgctacattgctggcaaaacctctgcctaattccagctacaagcacaacctgagccttagcatgatgtccacaaaccttatgcctcctatgatattgctttgcatcagtcagattagctgtacacttctctacttgacaacacctcatccctcctccaccaccacttgacaccctccttcctccaccagcagcagcagcagcagtaactaccactttctttttcttgttactctcgaaaaattcatcttccataaaccccatctggttttgctcatacccttcatcatctgaagagtcatcagcactatccttcttcattacttccctccccatcaccatcctaatttgcttttcccttacatcatttctttt

SEQ ID NO: 17723 - DNA, 414 bp, Populus trichocarpa
  Predicted polypeptide sequence is orthologous to G2060
gcttcactcttttcttcttcttcctcctcctgctctagttcttgtctgttagttctttatttttttcccttctaaaaccaaacaaagatctccctaaccaaccaaaatcagccatccacctgccttgtatcacaaacaaaccctatctattatacgtctcattagtatttatatatttaatttttagaaagaaaaaaaagggggaatttttagaacaaatcagtaaaaaaaaaaaaacctaatagaaaagaagatgaaaagtattcaattctgaatggaaacccaattctctttacccagatcaaccacttacgcctctttccggatcaaccgcttctctctcttctcaggaggctgattgattgattttccttcttttttttgtaaaataaaaataaaaaaaaaaaaaaaaaa

SEQ ID NO: 17724 - DNA, 917 bp, Populus trichocarpa
  Predicted polypeptide sequence is orthologous to G2071
ttttttttttttttttttaggataacatccaacgaaccacggtggtaatttattgcatattttacaaatcagcaactgattttttggggaaaaagaaaagggatcttcatattttacaaaaacatactgcatcatcttttattattcctcctaaccaggaaggctgaaacccaattgctgaactattattggctaaccgcgataaatcaccaaaaaatccaccattagtattagcctttgcagccactggaatatcctccctcaccaccccagctctcaccaagaactcctccaaagttatctctcctaaggtaggctgcctctggggcacattattagcaactccagcactagtcccattaatagcatattcctttgacatgtctttccagacctcatccaccgtcttcaggctcagtgtccgcggcagcgtcagcgagccctgtcgctggagaccaacaccatcttgtaccccagcagaggttgctgttgccacggtctgcgtctcctctgcactccatatactctttaacagctcatccatgttcattgacccaaaatccttccctaatgatcctcccatggtgttttgaagttcttcaagcgttaaagaatagatcgatgactgactagccaacggaaaattccccggtggccggccaccaccggcatctgacgggtcatttgtgaagctcttgaaattgaaattagtccccattttcaatatatctggataaaacagggtcaaaacagctaaaaaatctgacaactaaagccaaaaaaaagttaaaaaccctagccttattgcatttccaatcccgtgatgatacttatcaaccaaatcccgcataaaaaaagtaaaaaagtcttcaactttttatttttcaaaacaaaaaaagcacgaacctgagaacaca

SEQ ID NO: 17725 - DNA, 899 bp, Populus trichocarpa
  Predicted polypeptide sequence is orthologous to G2085
ttttttttttttttttttagattaaagcatttggtagtattaattaaagcatttggtactatatataaccagcaagctacatcatcgaaacttctatgtgatacatccagagtagaatcctatagaggtaaatctcatgcactacaaaggtaaggacgagataacttcatgtattgatgatgatggcactataacatctgtacattccactggacaagctggaattaattactagaaaaccttcaactttaattgatgccgactgctatagccattctttaaatgcaactcagaaacacagtcaatgctctgttattaaggctgtatcaccaccatttgcgtaagtaacaagattgttgtctgtatcaatggcagttccagagtccgaatcattggcttcagcttcaccctgctcaatcagagtagcagaatgatccgttttcttggtgaggtctctcaaagttcccctgtttgcccaaaaaaagcccacaggcattgcaaagtgaccttggaccagatggaccacgccgcatcattggggtggattttgaattagtgccacaatgcgtacacgaggtttcttgttggctatcatctagtcctgaatcctgaacaccatcccagccatatcctccctcagacttcttggcagaagtaaattgacccttattccgttgcatcctgagtgcaacctcctgacggacaccatatctaactttcttatcaaagcatcgctcttttctcttctgccggaacctacttaatgaagctgctcgttgaggttgagtacaccgtgacgggtagtccaccacacccctttggttttgaggcgtcatttccagaccaggagttaattcacatcctcccagtaataataacacagcttgaaccttatcggg

SEQ ID NO: 17726 - DNA, 893 bp, Populus trichocarpa
  Predicted polypeptide sequence is orthologous to G2094
ggtctgtcggctctctctctctctcactctctctctcggtgaatgtcggttcatttaaaatcgacactcttatcattcaccaaaccatctcctgattcttgatccctgcacattaatagagtgcttgtctgagttactgatttgcttctacttgatctctcttcctccaaatccacaaatcttgtcagatctccctgttctgatcagtagagcttttagtgaatccccacttcgaagtacaactcaatcattagtgttattcaaaacctgtttgaggaaatcgtgttttaggaactgggttgtctttagatctcaacattagttccttacaatgttggatccagctaacaaaggatcagagtctgaagaaatgagtagcaattcacaagaaacagagagcccactaaaaaagacttgtgctgattgtggtacttcaaagactccactttggagaggtggtccagctggtccaaagtcgctgtgtaatgcttgtgggattagaagcagaaagaagaagagggatattttagggttgaataaaggggcagcaaatgacaagagagcaaaaaagggaagcaataataatggctcaagcaataacaacaacaacaagcagttaggtgatggatcaaagcagagattattggcactgggcagagaagttttgatgcaaagaagaaagctgggtgaagaagagcaagctgcagtgttgttgatggcgttgtcttatgggtctgtttatgcttaataagagtcgataatatgtgttaataaggggattgagaatgtattagctggctagattttaagtgcgtgttgtgatttgttgttaattttttttagtattagttatcatttttttttaggtgatttgggctaacagagtctgggga

SEQ ID NO: 17727 - DNA, 592 bp, Populus trichocarpa
  Predicted polypeptide sequence is orthologous to G2106, G2131
ttttttttttttttttttgccaaaatgtcttataattaattaatcgaaatattgataaatgaatgtctaacttttgtctatatctacatggaaatgaaacaataaaaattagcaaactctcgtctttccaaattgtaatccaagaagagaggcattgtgcctaaaaaaacatgaattgtaatatttaatcttacccttttcatgatcatcatcatcgatctttccctcttgtcaacatcgatccttgactccatattcacaaaaccaaaaatatttatgttgcgaggatattagacttatttgggccaaataccatctcctgtccatccaattcgtagtggaaaatcggcgaagcaaatggatttagctccccgaaaatattaatatcatcgtcatcagtgtaactactagagtcttggcaatcgaagacggtttggatgtcatccgggaagctccggcgtggcggatcacgatccgactcgggtggcgtcaaggggggtagtggcgtcaaggggcaatctgcagccgatgttctttccaatatttccttgaacttggaggattgcaacaaaagccctaatgctgatgaggc

SEQ ID NO: 17728 - DNA, 776 bp, Populus trichocarpa
  Predicted polypeptide sequence is orthologous to G2113
tttttttttttttttttttagtttataatccattgattaaaaaacattaaataaaaaaggaatacagtgatatcaaacaacaggaaagaaacagaatttcttcctgctgcaaaaagagatctgctaatacgtatccacattcgtgaaagtaagaaaaaaaactaacagatcacgcgataaacctctctttttgggggctcttgatctctaatcttttctaatgtaagaataaaaaggcaaataaatttctgaaaaatcatgcaatctccggtgggggaggaaggttaagattaagatcaagatcaacagaacttcttagcgtcttgatatcttgatgattcaaatcaaagacgatagatgatgaatcagaatcactttggattccaccacaagaaaaacccatcggctggttaggatgatgatgatgatgatacccattatcaaaaaccgtcttttggcactgactcttcatcactgcatcaaaataaatcacctgctgatgattcatcaccatcggctgaaacggcaatctcacggtggatacagcaggaccgagattaagatccaacggtgtatcactgctggaaaactccacggtactgctttgacttggactctgattgttattactattgccgccgccgccgccgccgcaactgttattcttgttagatgctttatggttgctgtccacagagatagtgtttttcctgacattctcgtatgatgggtaagcaaagttggttttcgccttagaaccacggaactcacgtgcg

SEQ ID NO: 17729 - DNA, 921 bp, Populus trichocarpa
  Predicted polypeptide sequence is orthologous to G2130
ttttttttttttttttggaggaaagaatctacatatttttgcagattgcaagctaaaacttacaatttttagacaaaactactacagctaaaatggaaaaaccaaacaagtcggtactaatccaaaactcccctcggaatttaccaaaccatcataccagtaggtagatagctataaccttaaaacccaaatagagagtgattaagcctcaaagtacttgtcgacatcccataaacaggagccgaaatcaccatccaaatgtaccgagatatcagcataatcttctctcaaaacagtatccggtacactacactcctcaaaaaaaaaatcggagcaggattttcaaaatcccaaaactctttcaaacacaaaggatccgtaaccaaacactcatcatcctcaccgacctttattatttcttcttgaaccacctcttcttgcgtttgtatcctccagcaacaatcactctgtacggcaacctgtgactctggccccggttcctctgtagattgaaatctaagcacagaagttggagaacacagactattatgagattctttaccagactcatacccagaaatgttaacgttaatatcaacatctggggcatgttgtttgctcaccggaggttgtgtaaaattggtttgtgcatcaggtcctttaatacgaatagcagcctgatcataaaccatggctgcctcctctgctgtatcataagtccctaaccatagccgggttctcctataagggtctctgatctctgctgcccacctcccccatggcctttgtctcacaccacgataccttttcccccctggataagaactctgatcccttgaaatttttttcacaacttgttgccggcttaccacttttgaagatttttttgcatcttctgctgctctgtcgctcccacaactt

SEQ ID NO: 17730 - DNA, 756 bp, Populus trichocarpa
  Predicted polypeptide sequence is orthologous to G2140, G2765
ttttttttttttttttttgactaaaagccaacttacattaattattaaaacttctgtcgaagatgtaattgaaataacttcacaaagaaattatattgagataataaacattataattactacactatgctatcaataattttcattgcaacaagtgtagcacatccagccatctatctgtcatgcagagatgagacgcgtgtaagtctacgattctcgttttcatacagaacaagccaaacatgcaaggaatcaactgcagagatccccagaagaagatgatgagaacggctgcaacaaaccaacccttctcctcttattcgaaagcgtgggttttaatgagaattcctgcgaggcagagaatttgtcaagtacggatctaaaggccttgtggacggagccggcgagaaactggcgtactttgctatcaccaccgagcccttctttgcagctgctcatcacaagaacgttcatcatcctgccctccaaagtcgcaatctctgccctcgttatcatcagatggagagcatcgagtgcttgtcttaaaccagacaagatttcaggcttgtaatcgcaacatatagatgccctgattaaacatggggcactgcacaaaccatcctcttcctgttctactctcacttcatcaatatccagtggcatgagaaggccttcaccagctcctgctgcctggatcttcagctccttcaggtggcttataacttcagcaagcaatgatgccttgtccatcttact

SEQ ID NO: 17731 - DNA, 795 bp, Populus trichocarpa
  Predicted polypeptide sequence is orthologous to G2140, G2765
cttttatgcacccataaaacacttctctctctctctgctctacccgtacccaaaaaaccttctcgaatttcttgctaatcgaaacctcattttcacagcaaaaacactactttaccttactttttgtatcgtcaagcagtttaactcacacatactagctaaaacgtaagagatgcatccttttcaaagcttttactatttaaatcaagatgggcatataccagagccaagcttagtcaacatgatggacggtggggaatcaatcctgagctcagcttcaaaaacagaagctaaaatatcaactgagtcatcatgcaagagccacaaagaaacagaaaggagacgcagacaacgtatcaacgcccacctctccaccctccgtactctccttcccaaccccaccaagacagacaaggcctcgttgctggctcaagtagtgcatcacgtgagagacctaaaaatgaaggcagctgggtcggcacggcagtatagtaataactgtagcagcggattagagcccgaagagaactggccatatcctggagaagtagacgaggctacgctgagttgctgtggtcatgaagagaagatgataaaagtgagtgtttgttgtgaagatagaccgggtctgcatatggatttgactcgagcgattaagtctgtgagggccagggcggtgcgggccgagatgatgacggtggctggccggaccaagagtgtggtagtgatgaggtgggataatggcagtggtggagaggaggatgttgggattttgaaacgggctttgaacgctgt

SEQ ID NO: 17732 - DNA, 918 bp, Populus trichocarpa
  Predicted polypeptide sequence is orthologous to G2140, G2765
ttttttttttttttttttgagataataaacattattattgcactatgctaacagtaattctcgatacaacaagtgtaggacatctagccatctatctaatatgcaggcttgagacatctgtaattgtactactctcgttttcatacagaacaagataaaacatgctatgaccaactgcatcacaatcgtctattacaggtaaggagataatgaacattatacaaggagcaaccacagccaaaaaatcataggctcaccagagatctcctgaagaagatgacaaggacggtttgaatgagtcaacccttctcctcttgttcgaaagtgtggattttaataagaattcttgtgaggcagaaaatttgtctagtatggatctaaatgcctggtggatggagccagcaagaaactggtgtactttagcatcaccactatccccttctttgcagctgctcatcacaaaaacattcttcatcctgccttccaaagtcgcaatctctgccttcattattattagatggagagcatcaagtgcttgtcttaaatcagacagaattccaggcttgcaatcacaacatatagatgccctgattacataaggggcactgagcaaaccatcctcttgctgttcaactctcacttcatcaatatccaatggcatgagaagaccttcactagcttctgttgcctgcctcttcagctcctttaggtgagctataacttcagcaagcaacgatgccttgtccatcttcctagtaccaggtactaggctcctaagtgtgtcaagatgtgcattaatcctcgctctacgcttcttctcagcttcactatgattctttaaagcggcaatgcttctctcagccgccacccctttcctctccattctcacagtagcctccacaagctctcccctttcat

SEQ ID NO: 17733 - DNA, 752 bp, Populus trichocarpa
  Predicted polypeptide sequence is orthologous to G2140
ttttttttttttttttttggggcgtaggagaagagaagaaagagttgtatagtgaaaattcaaaggcttaatggttaaacgattgtttagcgaagccactagttgcgagtaacaatagaggagtgcctgggccatgcttaaaacaaaatattaaaaaatgcctgcttgcgtgttttagaaacagaagcttcttcctcttccttccttgatccaccaaaccgatcagaaccaaacctaaccttttaattctttccctttccttttctttttgttttcgttttcgtgcgtagagagagagagaaagagagcatcaattcctcccgagcaatggaaaacagtcataaatggatcacgcaccaccaccacagtgaccaacgccaccctttcttaaattgaccaccacctcgacggctcgaccctcccctgccctgcccaccaccacgtctgtgttaaaacacactaattttgcaagaattatttgtgcgtacagaatatgcttcccactcacgccaaaaaagcacgcacctaatcttctttttatcccctcattctaacgtttcaggatatcttcctttccaattggacagacggactggagcttgcaatttccatgattgcccacaactaacaaatcttagttagagccactggccttccgtttgtcctaaacaacaaagttaagcggattctttgggcaactaagtgtgtgcgcgtgtatatattaccgaaaaaagaaaaccttcaagcgaatc

SEQ ID NO: 17734 - DNA, 932 bp, Populus trichocarpa
  Predicted polypeptide sequence is orthologous to G2142
ttttttttttttttttttggtaaaaccaagcagcttcttattatacgtatggaaaagcctctatctgaaatgagaaaaccaacagggaagataagttctcattcttactttcttccaggatactccacgccactgggaaacaagccaaagagcatatataatacatacatgtacaactgatccgaacctggctgtggatgatggacaaacaaaaacggacaccgaattttctgtaggaccaaatgaagtgatcaagctggtagatacactatgagccgaatgatacactagcatttttctcttcttggcctcttatgagcttgttctgagttttctgcactgctcccaactccatcttgcacgagtagttgattgcttagatactggtttacctttgaactgggtgccacagcagttgtactattttctcgtttgccaacatcaatttgcactccgatgcttgtctgtgctagatccacaccagaggattgtagtgcttgggtcagagtattcaatatctgttgagaataggcatttgagatattaactgatagactgtcactcgccaagtcctcctgtccattcagtgtattgtttggagtagaacactcagtagcgcatggtctaccgtgcaacagctgggattgaagctggtaagccatgttctcaacgtcagaaacagattcctgcaaagactgtgtaggcaaaccacccctcccaacagcagcaaatacattcgatggtgtctgcacatcaaatggaattgctgggttggtgggcccagggggatgatccaatgttttgtacattgcagcagcgcccatgtcagattctattgagttatgtacatttgcaagcatgacactattctcatgagcagaaccatttttcataacttgtgtatgatcaagtaggctttcggcagaagcacg

SEQ ID NO: 17735 - DNA, 868 bp, Populus trichocarpa
  Predicted polypeptide sequence is orthologous to G2142
ttttttttttttttttttggccatggtatgaaatggccacaaatctaagcaactccactgaaacatatcatctaaggtgacagctcttaacatgattccatgaagtatgtaagaatctgagaaaccaaaagcatagcatgtacattaacccaatgactgatattcggaaccaaaggaaaaccgaatgcaaacttgataaatcccatggtgccttacgatgtctttagccgcttttgagcttgatctgaatcctctcctccacttgcatccctaaggtgggttatcatttcattggtaggatggggattctggggatccttagatgtcaatgtaccagaggtcagccctctatttgcccgttttccgagatcaatctgaactgagatgttagcttgtgatagatctacaccagcactctgcagcgattgcgtaagagtattcagcaacaagatcgtacgcactcttgagagtaaacactggagatattgattgtccctgcttcaattgccagctcctgctggttcaacatttcactggtgatgggacactcagctgattgagcatcagagactggtagttgacaggggtgagcaacaagtccaacacttcgaatgggagcaggcgtgggaagaggcatagccttgtttcctagctcaggttggtgttccaacactttgcaagcaacatggtcggattctactagattcggtgtgcttggaagcatggctggtgtgagagcaatgttattctcatcaagtttacctggaaatgtttctcctggaacataaccatttttaatagcttgagggtgaccgacagaactttgaaggcgccagtggctgtttctccatggcatcaactttgctgg

SEQ ID NO: 17736 - DNA, 526 bp, Populus trichocarpa
  Predicted polypeptide sequence is orthologous to G2144
ctgaaaccaaacacgccacaacacaactcataacagaaaaccgagcactccatcatttgaccctctgtctctctataaactgaccttcttaaattaaattaaggaaatggatcttacaaccgcatccggagctagatccggacccgagcttgacgaaaccggactggattccttccaactcggtgaagatatccgtcacttaatcactgcgccatcagaaaacgcgagttctttcattgctttactagaattaccagctaaccaagccgtggagttgcttcattcggactcgggtcaaaaacagtacccgaacttgacttttccctcaaacacttccgccatattctccgtttttaatggcggtagtaattcaacggattccagccccgttccgtcaaactcgagctcgaaggatctcgagaaagcatcagccgttaagtgtgagccattagagacggggtcttaccttgattcatctcatccgttggtctctgatccaaccgtggattattcggcgccaaatgca

SEQ ID NO: 17737 - DNA, 925 bp, Populus trichocarpa
  Predicted polypeptide sequence is orthologous to G2226
ttttttttttttttttttgggtggagatcaaagcaagatagataggttaaacatcacttcttcacaatatgtacaataaaatttttggtctctcaaggacccatcagcacatcatgcttgatctcaagcacaaagtatacaccactatgccctgcccgatgcactcacgtaaatacatgtacacgctgtacaaggagaattcctctgacaaagcatacatggtagtatgcgctcaccaaaagcaagatgcatcctcttcaggcagcaatggagtcctgcaaagagggcatgtaatgttccaatagtccaaccacttctccaagcacattttatgaaagatatggccacatgacaggctatttatctccgattctggctcaaattgggtcaagcaaaccgagcagtcatgttcaggctgtttacagctgcacaccgtgttgaatcggattgatggcatcctgcttcggaactcctcaatgtaattctctgggggacttaaacgaaattcaaacgactctctggtgtcttcagcattatctgacgatgggagtgaagcagatggtgacaaacggatgccaacaatgtgaaggattgaacggactatccctttgacaatggaaattgacaaggcagtgtttactaaaagcacacatagtactccttcagatggagctggcagacttgatagacccattgaagtttcgtgggacttggttttttttgcagtgattccgcaaagctcaagctaacaagagattcttgattcacagtgtgctcaaatggaagttatggaagccaatggggggatacttatataaatcacagttgaagcgaatggagaaaaccggatgattccttcttttcttgatcttggggcatataaacagggtttttgactatgatgaaatgatgagtagcaaaatcc

SEQ ID NO: 17738 - DNA, 706 bp, Populus trichocarpa
  Predicted polypeptide sequence is orthologous to G2239
ttttttttttttttttttcttttttttttttttttttttttttttttttttttttttttcccaaattgacctgacctattccatgttgatgatcttatattaaattacattaatcacaaaaaaataaataaaaaatacccatcttacaaatgttgacaaagtcaaaaaaaaaaaaaaaaaaaattaataggagcatcctaaagctttggacaagcaaaattacccttctaaaccgggggtctgctaaattcacctccgtctgatccaccgagtctaaacaaacccccttggttttcactagcacccaccacttttggtgacctaaccaacaataaagctctcgataaaaacgacaaccctcttgctaaaaatgacgggttcctaccaaaaacccaccggtctgacctcagttctaggtccaatttctcaagtctcttataatttaacacctttcttgaactcccttcaccaactccggtcctataacccttccttgaacttccttgtctaggcagcaccaccatactcgtaaaccggttcaacttccggttcatcacctgtttcctaacctcaaccggcaatctcaaagtaaagcgatcggtgttctctcccggttgaaccaaaaaatgcccggtcgaatgtgaccaaggaaacctcggtggcctacccgatcttgacccacgtgtccggttcctattcaaagttt

SEQ ID NO: 17739 - DNA, 873 bp, Populus trichocarpa
  Predicted polypeptide sequence is orthologous to G2319
ggagagttggactgaagaagagcatgacaagttccttgaagcccttcaattgtttgatcgtgactggaaaaagattgaagattttgtgggttcaaagacggtgatccagattcggagtcatgcccagaaatactttttgaaggtccaaaagaatggtacaagtgcgcatgttcctcctcctcgccctaaacgcaaagcctctcatccttacccacagaaggcgtcgaaaaatgttttagtgccgctcccagcatccatggcttacgcttcatcgatgaatacctttgcaccaggatatgctctatgggatgaaacttcagtgttaataaactccgcaacaagcaaaatcatgccatcacaagatgaacttccaaatcttcacggagctgaagctgatattggaccaaagtgtgtatcaagtagtaacaatactgtcagtggccttgggacctcaagtagaacattgccaagtgctgagatgccaaaacaagggaagcaagcgcctgtgcttcatggtataccagattttgctgaagtatatagcttcattggaagtgtctttgatccagacacgaaagggcatgtggaaaagctacaggaaatggaccctataaattttgaaactgttttgttgttgatgcggaaccttactgttaacttgtctagccctgattttgagccatataggaaggtcatgtcatcatatgatgtcaataccaaaacagtgggagtttctgccctgaaacagaccaatgatatagcatgttgaactacttacattttgctgactttaacgtggtgatgttggctggaattcttgctgcatcactaaaatcaaataaatgtgtctgctttatctttctgcacatgcct

SEQ ID NO: 17740 - DNA, 905 bp, Populus trichocarpa
  Predicted polypeptide sequence is orthologous to G2319
ttttttttttttttttttaaacccgctgggcaaatcagatagaagtctagtatatatggagatcattcaaatacagaaaataacatacattcacaaatctgacgggcagtaccttttctaatgtattcaaattcttgtagttacaatgcctaggcaaaatgtacgctgctatacgcaaaattatattaagggacggccaaaccaccaccaaacagatctcgcaagatatacacgcttgtttggttgaaggccaaatcgtcaatataatagaaacagccattgcaaatgaggtcagtagacatcaaggtacattacacgtacgaaccttgaaaatcagtcaagaactttcttctaccatcataaactatgaacttccaagcatgtgcagcaagatacatttatttgattttagtgatgcagcaagaattacagccaacatcaccacgttaaggtcagcaaaattttagttcaacatgctatatcattggtctggttcagggcagcaactcccactgttttgctattgacatcataagatgacatgaccttcctaattggctcaaaatcagggctagacaaattaacagtaaggttcctcatcaacaacaaaacagtttcaaaatttattgggtccatttcgttgagctttttcacatgccctttcgtttccacatcaaaaacgcttccaatgaagctatatacttcagcaaaatctggtataccatgaagcacaggtgcttgcttcccttgctttggcatctcagcactcggcaatgttctacttgatgtcccaaggccactgacagtattgtaactaaaccttgatacaccctttgttccaatatctgatacatcctttgtttcaatatcagcttcagctccgtgaaaattagcaagctcatctt

SEQ ID NO: 17741 - DNA, 566 bp, Populus trichocarpa
  Predicted polypeptide sequence is orthologous to G2343
ttttttttttttttttttggaattcttggattaaaaagaagatacgaaagccttcagctcctgcaacaataaccaatgcaactaccagtactgatcattcaaatataaattataactcaaaccaactagatttaggtcatcaagatttgacaaggccacaagttcaagaaaccctattttcgtcttcagctcccttatttatgtttgacaccagtactgcctcacttgatggaattgtggatagtagtgtacgtggggagctttttcatgattcggcaagcttaaacactgaaacttggaattcaagccagcaccatcatgttcaagcagtactgcccccccaagcaacttttagtattggaatggatacaaattacttgcctccattgattgacaacatggagaacatggtgcctattgagatgcaatcctgtagcatgaatgacgaaggagagatatcattggaatgcttacaaaggcaagagttgaatattgaatgggtggaatcccaacaatgctcaaactttcttttttgggataatgttgaaggaccacttggtggagaa

SEQ ID NO: 17742 - DNA, 606 bp, Populus trichocarpa
  Predicted polypeptide sequence is orthologous to G2348
ttttttttttttttttttagtaacttattccatcattatcattgccaaaaaagataaaacacgaacttaggggtgaaagctgttgtcagtacaaggaggaaacaaaagatgcaagaatattagacattgcctacaaagaattctcatccaactggaaaaaagcagcagatatctccaactcttgggaaggccgcggttctatcttgacactcctacaagggcaagatcaaggcagcatggagaaatagcagtttggacactccaaagtcaggaatcaaaccccatccttgagcttcaggggggtcaatttaatctaacagtgtaaaggggatgtacagagccagtgatcaagagatggcattttagtctggatttatttaacatctaaaatctgtctgtcaagcacctgcgtatggatactgcgagtttgctaaccttatgtgggtgcagaacaatggcgcatactccaaaacaaacagcaataagagcaactacataaaatgaaggacgatacttcaagactctgttagagaaaacgagaccacatgacttctttggtctttcattgacaaggttcatcctcatgacgacatctttagtcaaaac

SEQ ID NO: 17743 - DNA, 662 bp, Populus trichocarpa
  Predicted polypeptide sequence is orthologous to G2372
ttttttttttttttttgggtaccaagttgtttccaaagaccttgtcaccaaacacctgagaagcattttcacttattaagttggataaactgaatgtggaaaaaggatcttgcctggctccctgcatgccagcaggaaaagtactataattcaacattgaagcattcatgtgccccgttcttgaattagttaggtctgacatcggaaagaaaagttctccatttgtcaggaacccagaatcattaggatatctcaatttcttcattgggggggatgcgtcttgaattggcagtgtggttgcaacaaattccacttgccaagggctcactctctttacattctgcagaacttcaggctcatcccaagtaatctgaagcatgcgccaaggagagccacgccatgcaccacagtcaggcaaaccagtacccgaaacagtcccctgaaaccaagtcattctggaggaatcctcagtctccacagccatcttcactctcatcccagcagtccaaaacacacatagtgcagcttccaccacttcagccctcaccacaaaatctgaataccaccctgccctcggatagtagacaacctcaaacggcaagcctttagccgccctctctactgcctccaccacagcctcttgagacaccgccctctccaac

SEQ ID NO: 17744 - DNA, 456 bp, Populus trichocarpa
  Predicted polypeptide sequence is orthologous to G2404
tctctgtgccaaaaattttattcactcttatcattccatttccacaaaattcactttcattctccctctgcctctctctgataaacaaagcacaaagatcatgccagtttttgcagagagcagtagcagcacaccagcagctatagcagaccaaatcaagctaagaaaacccagaagccaacaagagctgcaacccatttcaactgaaacagatccaaacccacatgcttccaagtcatccaaatccaacacaattatctcctccctcttccactctcacttctctacaaccccacctgaccaatccaagaagaaaggtgccacctttagaggcctaggatgcactgctggagcagctcagcaagtatcggtgccggcggtgataaggtcatccgcggactgggaagggaaaaaggtcaagaagaaaaagggccatccaaaaaaaaaaaaaaaaaa

SEQ ID NO: 17745 - DNA, 904 bp, Populus trichocarpa
  Predicted polypeptide sequence is orthologous to G2455
gaactttgcttagtgttcacttttctcttgttaaagaattctattctctcccttgatctgtactcaaatccatagttttcataaattagcactaaaaaagatgtctctggagttggtatctgaacctgtttgttatgttcactgcaacctctgcaacaccattctagcggttagtgttccaagcagcagtttgttcaatattgtgacagtaagatgcgggcattgtggcaatttgctgtctgtgaacatgggagcatccttacaaacacttcctcttcaagatccccaatcacagaaactgctccttattaactcagaagatttgaacaagaactttggttcatcttccaaatgtaacaaggtcactgcttcagagtctactgagcatgaaccacctaggatgcccgccatccgccccccagagaagaggcagcgtgttccttctgcatataatcggttcatcaaggaggaaattcaaaggatcaaggctagcaatcctgacattagccacagggaagctttcagcacagcagccaaaaattgggcacattttcctcacattcactttggactgaagctggacagcaacaagcacgctaaattagaccaccagtcatttgcaggagagggcacccaaaaaactagtggattgtacgagatcaatggctccctgtgagtagcacgtagaattacatatctctatttcaagccacggtttttctatgtataaacaataataacaactcgatcgatcgaagattattactgcatataagaggtttgatgttgaagtctcctaattaacaaaataggaagaccggccccctcttgaagagcctcacagccccatgcatgcacaaaaaccttccccgtttcataaatatatatatttgtgtgcgaaaaa

SEQ ID NO: 17746 - DNA, 767 bp, Populus trichocarpa
  Predicted polypeptide sequence is orthologous to G2455
ttttttttttttttttttaaggaaattaattttttttaatatgaaattaacacacataattataaaatcttcgatgatactcgaggtattattataattatacatggaaaaaaagtagctatatatagcttattatatatgtgtgtgtgtgttttactactcacaggacaccattgatctcgtacaatccattagttttttgagtgccctctcctgcgaatgactggtggtctcattaaggatgcttgtcgctatccagcttcagtccaaagtgaatgtgtggaaaatgtgcccaattttttgctgccgtgctgaaagcttccctatggctgatgtcaggattacaagccttaatcctttgaatttcctccttgatgaaccggttatatgcagaaggaacacgttgtctcttctcaggggctgggcggatgggggacattcttggtggttcatgctcggcagacttaaaagcagtgaccttgttaggtttggaagatgacccactgtccttgttcaaatcttcagagtttataaggtgcagtttctgggcatcttgaagaggtagtgtttgtaaggaagctcccatgttcacagacagcaaattgccacaatgcccacatctaactgtcacaatattgagcaagctgctgcttggaacactaaccgctaaaatggtgttgcagaaattgcagtgaacataacaaacacgttcagataccacgtccagagccatcttttttagtgctaattaataaaactgtggattt

SEQ ID NO: 17747 - DNA, 926 bp, Populus trichocarpa
  Predicted polypeptide sequence is orthologous to G2456
gggagagagaaagtgaacactttctggttctgctctatctcctagtatattagtagtagcaggttcctctctttccacatctctctcttctcttttgctatattaacaagtcaacaatcaagaagattagatccgaggaagaggattattatctgttctttcaaaatatccaccgatcagtcaatccatcaatcaaatcaacaaaatctctaaaagaatcataaaagaaatggcatcctcttcagctgccttttcaccggatcacctctcttcatcagaccagctttgttatgtccattgcaacttctgtgacactgtcctcgcggtgagtgtaccttgctctagcttgttcaagactgttacggttcgatgtggtcactgcaccaacctattttctgtgaacatgcgtagcctacttcctgcagctaatcaattttaccttggtcatggtttcttcaatcctcagattaatatcctggagggaatgaggagtactggagcaccgccaagtttgatgatcaatcagccaaatccaaatgaatctgttatgccaattcgaggtgttgaggagatccctaaaccaccagtggttaatagacctccagaaaagagacaaagagtcccatctgcctacaaccgctttatcaaggacgagatccaacgtatcaaagcaggaaaccctgatataagtcacagagaagcatttagcgcagctgcaaagaattgggcccattttccacatatccatttcggacttatgcctgatcaacccgtgaagaaaactaacgtgcgccaacaggaaggagaggacgtgctcatgaaagatgggtttttcgctccctgcaatgtgggtgtcactccctactgagaagtggagctattaaggttttcttttgtacttccctctctacatagccatgtctttt

SEQ ID NO: 17748 - DNA, 860 bp, Populus trichocarpa
  Predicted polypeptide sequence is orthologous to G2456
ttttttttttttttttttacatagaacatctaaaaagcacatgcaatgctaggaacatcagatgtctacattaattagaagtgcttgtagtagatgggtaatgaagtaattagactagttaaagtacttgacaaacgtcttaaccttaaaatctttctccaactactaagattagaagctaaaattaacaagatgagaaggacgtagcagctccacttcttagtaaggggtagtgacaccaacattagaagaagcaaaaaacccatcgttgatcagaacatcttctccttcctgttggcgcacgttattcttcttcatggcctgatcgggcatgagaccgaagtgaatatgtgggaagtgggcccaattcttagccgctgcactgaatgcttctctgtgacttatatctggatttccagccttgattcgttggatctcgtccttgatgaagcgattgtacgcagaggggactctttgtctcttctctggagctgacagttattactaaatcaggactcgtctgtggataacgggtggcctcggaagttcatgatcagccattcctcgaactgtaacgctaaagtcattcacatgggtttgattgatcaagaagtttggagttgggtttgggatctgatcatccaggagattatgagaaggagagtagagattgtgacccaagggaaactgactagcagaaggcaaaaacaacccacgcatgttgacgggaaggagattggtgcagtgaccacatcgaacagtaactgtcttgaataagctggtgcaaggaacactcaccgcaagcacagtgtcacaaatgttgcaatggacataacagagctgctcggagggaggggact

SEQ ID NO: 17749 - DNA, 442 bp, Populus trichocarpa
  Predicted polypeptide sequence is orthologous to G2456
ttttttttttttttttttagcacataggcttcacatacattcagaggcttcaaaaccctctcccagaccaacaccaacaccaacataagccaacagcaaccccattaattcttaggggtcttctacaaagaaagcttaaaagaagtaccttgaaaacaattacaagaaaattaaaagacaagggtaaattaagcgggaagtaacaaagaaaaccctaggagctccacttcttagtagggagtgacccccacatttgcagcagcaaaaaactcatctttcatgagcacatcctctccttcctgttgacgcacgttagctttcttcacaggttgatcaggcatcagtccgaaatggatatgtgggaagtgggcccaattctttgcagctgcactaaatgcttctctgtgacttatatcagggttcccagctttaatgcgctggc

SEQ ID NO: 17750 - DNA, 823 bp, Populus trichocarpa
  Predicted polypeptide sequence is orthologous to G2457, G2459
ttttttttttttttttttagcctttaggaatattcatatagatgacgaatgtaaataacttacatcaagtcaagtaagcaatcacatctgctaaacagtcggggacaaatacaatattgtagaaaacatagactcatatcctccttgattacaacacattgaagtcaaggatgtacttcaaagagcatggaatttcttgaaggtggtcttgaaatatcaaaaccatattgatcagttgttcagtagtgctgaccttgacattagatgcttatcacttccatcatccagcttagcttggttgttggtctccaacatcaatccaaattgaatatgagggaaatgtgcccaattcttggcagcagtactgaaagcttctctgtgactgatctcaggattattggccttgatcctctgaatctcctcttttatgaactgattatatgcagaaggtactcgctgcctcttctcgggagggcgattaacaaccctttcttgagtgacaatgttggtagctggggttctcgttgagatcttgttgttgaattttgaggaggaacccatgtcaattctgtaatcatgtgatatgtggtttgatgcctgaacatgatcttgccatgacagtgactgaaaggcagctgccatgttcacagaccatagattggtgcagtgcccacatcggacggtgacaatgtcaaacaagttgctgcatggaacactgaccgcaagaactatattgcaaaagttgcaagggatgtagcagagctgctcatgaggcaccacatcgacgcagcttgacatgatgagttttttaaggaaattaatt

SEQ ID NO: 17751 - DNA, 891 bp, Populus trichocarpa
  Predicted polypeptide sequence is orthologous to G2457, G2459
ttttttttttttttttttagatattgacgaaatgaaaatagcttccataaagttcttacataaagtgaagtaaacaatagcataaacagttggtcacaaatacaatattggagaaacatagattcatatatatatatatatccttgattaagacacgttgaagtcaaggattcttaatttacttcaaagagcatggagtttcatggaggtctggttttgaaaaatcaaaaccatgatcaattgttctgcagtgcagaccttgacattagacgcttctcactgccatcatccaccttagtttggttgttagtctccaacatcaatccaaaatgaatatgagggaagtgtgcccaatttttggcagcagtgctgaaagcttctctgtgactgatatcaggattattggccttgatcctctgaatctcctcttttatgaactgattatatgcagaaggtactcgctgcctcttctcgggagggcgattaacaaccctttcttgagtgacaatgttggcagctggggttctcattgagatcttgttgttgcatttggaggaggatcccaggtcaattctgtaatcgtgggagttgtagttcgatgcctgaacttgatcttgccatgacagtgactgaaaggcagctgccatattcacggaccatatattggtgcagtgcccacatcggacggtcacgatgtcaaacaagctgctgcatggaacactcaccgcaagaactatattgcaaaagttgcaagggatgtagcagagttgctcattaggcaccgcatcgatgcagcttgacatgatgtttctcgaggatattaacaatcaaaagattataaggtctttaggtcaagaagaagaagaaggaacacaacaaacaagaggaagc

SEQ ID NO: 17752 - DNA, 942 bp, Populus trichocarpa
  Predicted polypeptide sequence is orthologous to G2457, G2459
ttttttttttttttttttgcaagcacgactatgtatattaattgttcgttactgctagcattcttctgcgtataacatccacttaaatattacacgtctttttgtttcccctaacacagtcttgcaactagttttattcaaaatggtccctgtaaaagtcactgattattacaataagcaatgaaggtaaagctttggagtcttgcgccagaccgaagctgagaattcattgaaatgaacaagctattatcaaaataatcacaccatgattactttagtttataaggaaacttcttggcaatgatatggccaatatgtttttattaggctccttgctgcccggacgtacgtgcaccttatgcatccatgccggtgtcgttgagtgttagaccagactgggtgtgagggagatgagcccagttcttggctgcattgctgaaagcttctctgtggctaatctcaggatttttttcttttatccttctaatctcttctttaataaatcggttgtatgctgaaggagtccgttgtttcttccccgttgcagcatgcactgctactgttctgctgggctgttcattctgggaaggttccaatgcagaaaccttattgcccgtggaagaagactgggaaccctcgcttaaatcttgataaagcaagttttgtttatgagaattttgaggatgagaagtctgtagcaaagatcccgtattcaaagacagcaaattagcacaacgtccacacctaacagtcacagtattcagcaatatagaattggcactgcatggaatattaacctgcaaaaggattatcccaaaaaaaaaaccctcaaattttaaaattatatagacatcttgtaaatggaactgaatagattattaaaaacagaaattactatatgagctttcaaatttatatgcatatatatagtaaaatctctcc

SEQ ID NO: 17753 - DNA, 418 bp, Populus trichocarpa
  Predicted polypeptide sequence is orthologous to G2492
ttttttttttttttttttagttggaaacatccagcattagtgctgtgccaatcaaaccttgtacagaaatcatcttcctctgtttctatctcgttcaacaaaaattatatgttcaacctgtagtaggtaacaatcccagaagagaatctactcgactgacgaggatgagaacagaggagattttttaccgtgactattttatgaacctagaacataaaactagcacctgaaacaaaaagaaatcctgcctaaggatgatgacactgcaagtcaccccttcttcctcccagcccagccttctctttctcaaaccttctcggtttcctccactttcccatccttcatcagaaaatctacagcgcgtctcgcagcatgaagtaacattttctttatctccagcttgtcttccttggcctga

SEQ ID NO: 17754 - DNA, 908 bp, Populus trichocarpa
  Predicted polypeptide sequence is orthologous to G2520
gaaaagaagaagaagcgaaggtagataggctggagagagagagagagagagtgagtataaagaaaggaaaggttatactctaaaaggctggaggcttcgagaatagctcatgactactgaagtgacacgctcactccgtccactgtaaggaagtgaagactatttagttacaactcccgaggaagtgagagaggtagcacactgcgcaccaccctccactgtctaaggagatcacagaccaaatcatcactttgtctctctctcgttctctttccccgtctactggtattgggattttaataatattaaaatggatccgcctgcaaggatgaatgaaggagggccttacagtttggaggagatctggcaatttcccattaacgggagcggaagagggcactttgatttacttaatttggagcagagagcagctgcttctgtcaggaaacgtcgcgatgttgatttggatgttgatgatgattcttcttcaaaacccactaccaacggacttctggacttagctgttcctattttttacctttgaactgaattgggagcattgtgatggtaagcggcttaaaacatcagggagtaaagatgaggatcaccatcgtcatcatgattctaaagatgaagcagaacccagttcaggcaagcatgtggaacacaaaactcaaccaccagagccatcaaaacaagattatatccacgtacgagcaagaaggggtcaagctactgatagccacagtctagctgaaagagctaggagagaaaagataagcgaaaggatgaaaattcttcaggatctagtcccaggctgtaacaaggttattgggcaggcccctggtccttgacgagattatcaattacatccaatcattacaacgtcaggttgagtttctatcaat

SEQ ID NO: 17755 - DNA, 825 bp, Populus trichocarpa
  Predicted polypeptide sequence is orthologous to G2520
ttttttttttttttttttcggataatatttaatgtcttgtatatgaaatattacaagttaatacaacaactttgtatatgaagtttaacacagagctacctgctatttacattatttactttgcatcaatggaatatgatttttgtaacctgctatttcaaccataaaaatgatcttttagattcactattagggaacaaacaaagaactatgcagtaatttttctttctttccctttgaagactcgaaaccctttctagtttgcattctcagtctttttcatcatctttcagttatcgtacaaaggtccacagcaggaaagtacctgctttattctggaacagattcttgatttgaaaaggcttcagctcactgatgtcaacaacaatactcctatgaaacgtggtcaagaacaaaaaaacatttcttcaatgctgaatacctcaaagaagcttgactacaatctcaatcattcacaacattctcaagatcttgttaccattcttcaacaagctgactgccaacgtcagggtctaaaagtggattctttgcctttgccattttctcagccagaacatttacctttcttttcaactgccgcaaatgctttgcctggagaatcctggtgtagatcttttgcctccaagcttaacatctctcatcttggtcttgaatgggatttaatttagaactatgccgatgaagtttttgaaaatctccactgcaaacgttattccaggacggacgaggttagctgttgataatgttgggcatggacatctataatatttgcaaaacaagtttccctgtggccctgtgggctcg

SEQ ID NO: 17756 - DNA, 727 bp, Populus trichocarpa
  Predicted polypeptide sequence is orthologous to G2522
ttttttttttttttttttggttggaatcacgagcactaaaacttggaattgcattgtcattgagctacaagagatgagttcaacccatggtcaatcataagtaaatgaagtgagaaatgtcaagcagaatcagcctgtcttcaatcttcatcattggacttcagaagattatattcaagctgtactgaaacaggagagtatatacattgctcacagaataatcaatagaaaatccttatccgcgcatcagatcaatgtcaacatgggtgttccgcatatccactgaccgagaaccaggccaaacacccatagaagaggttggagtaagatttagacttggttgaacactagttggagttgctggattctcaaccgtctgatggtccgagtctctggctacttcagcaccttccactttcttgtttttagtctttgaaccaccccacaagaaacttccggctatcacctgaacagggcttgctgcaataagaactccaccaactcctccaccaataacacaaccatcaggactagctagggagacactcaaaccaccagttcgattgcgagagccaccgttgttagagaacaggtaagagccagataaacataaaatttcaaagcgcccctcatatgtgacagtgcctccagaagttgatggctgatgcagagtaacggtagagacagcaccatttgctgacaagatgcatatagctcttggaccctg

SEQ ID NO: 17757 - DNA, 837 bp, Populus trichocarpa
  Predicted polypeptide sequence is orthologous to G2543
ttttttttttttttttttgttgagttggggtggtaatgacagaaagattgcaaggaaaggatggcagtttcattactaccccttctaagcaagaaagacacggatggtgcgttcttgactccctcttaaatgactactcttccagcgtaaatttttgcaaaatccaaaaaaagggcttgtaaaaaaataaataaaatttgggtggtgtagagagtaatgaattatggcagcaaaaacaggcaccagcagcagcagcagtaaatgagcatcttggttcttgatgagagggcattcaaggtcccaactaaccccaatacttctctcccacattgaataccaccagcaaacacaagactttcaattttttccgatctccatatttaaagttggtagagagaaagggaaacagttgtgtttgcagtagcagaatcaggtcatcaggaaccaggacaactcaaggcagccttaatttgctggatggtggttccaataaggctattaacggtattcactgactccaggttcagtctagcagatggcaagctgctaactaatatttgaaaagctactgtgattagtgaaccactcgacctagccatgcgtccttgtgtattagagcttgtggatgcaccatctccttggtcaggataaccatcaggtgaaatggtgaatcctgatggcagaagaggtatataggaagggtcctccccactcattgctatgttgatggctggtagatcgacagggcaatagactacaagtgaacctgatgagtccatgcagctctcttgaagtattaacatattgttctggctagtgttgtaggcctattccagc

SEQ ID NO: 17758 - DNA, 369 bp, Populus trichocarpa
  Predicted polypeptide sequence is orthologous to G2559
ttttttttttttttttttctaactagggattcagctcacacaaaagaaaatatcaaattcaaactcgggtcttgtcagaacttgggtaatgtaacgcatgcactcccatttactgttttttacaaatatcaaaagacatttacagctgaaccaacaatatttgagcacagcataaactaacaagccaaaaaatcaagcaaatccaattctagcagccttttctctcccgtttaccccactgttgttcattagaatttgccaaaacatcttagacacttaagaatccaagacacttccttggtgtatacccagttgctcggaatttcgctgcagtttcctctaccttgagacggtcctcacctttttttg

SEQ ID NO: 17759 - DNA, 802 bp, Populus trichocarpa
  Predicted polypeptide sequence is orthologous to G2567
gaaaaatgattttattaaccttgcttgcttctcagcataccaggcttcacaattacgttgatgtttccgattcccgggaaacaatatgcactcataagcccaagcatcgtatattttacaagtaattcttatggcactcataagcccgagcatcatatattttacaaatttccttagccaaatcatataaaacatgctctcttcttttcatcgtctattttcggatttcttcaactggggattgaaatccttgtgggattttactttcagttctctaatcttggatttatgaaccaccacggagaaaaaacacgggaggaagagggaaggaaaaccactggttcagtggtaacaggtccgatgagagatttcaataaattccattaaatagaacctcttggaactcacaagagccatcttttaaattcttccgttccaaatggagggtttctcccattgaatggaccatcatcaagttcaaaaacctcgatttattcaggtcaggaaatgaatgcagagtgagcgaaaaagaagagggaaaaggatgaattgccggtgggggcgggggggcgttgcaggaacaagggtccatattttgggagctccaattccaattctccctaccaccacgccaaccgatcaaaacttttacattgcatacactctcaaatataatgcgcaatgagctaaaacaaataccaagaatgagtaaaggactggacccagcaggaaaggttctgctatgaccttaatccttctatagtttgatcagatttccagactacatcctttaaacctgacc

SEQ ID NO: 17760 - DNA, 717 bp, Populus trichocarpa
  Predicted polypeptide sequence is orthologous to G2575
ttttttttttttttttttgagagggcaacaaagcattagcggcatcgtgaccattacagaatcatcattaaatttacaaggaaaaaggagagagcacgccgaactgaaagactttgacaagaagaaataaattaacaaacccaaatattttaattgtgaattatctgatctccttgcatagtgtagcgacttgaaattgaacatttacacgtgaaagtcctatcagcaccttctcctctcacttccaattttggcagactcaagcaaactgccgttctcttgaagggaaccccatcatttaccttttgacaaatgggaaaagggcctttataggatcaatcagaatactacatacacaccaacataaatacatgtgtgtatatacatgtacataaactccagtagtcagaaatatgcattcaatgctctatgtgagcaccatactggtattagttcgtccatgaaaatccaagtacactaaagaaacagacagattaattatgagagggagagagagactagagagagttcaaggctgtttcttgtggatgaaggagggaactaaatcttgcaagaggccgtaatccggagcatagagctgatgctgatactgtggatcatggttttgatagaaaatcgaagtttggtcgccttggttacttggtggaagcaagcgagtcaggaaatcctgtggaaagctctgccctatcgatgtgc

SEQ ID NO: 17761 - DNA, 920 bp, Populus trichocarpa
  Predicted polypeptide sequence is orthologous to G2592, G2713
ttttttttttttttttttaaaagctaaacaagtggttctaacagttagaattaaaaagcaggctctcgccaattacacaattgttcaaaggattactacagagctgtttagatacaatgcactgaacttctcatacttccatggtgttgggatgatataacaagaaacgagtcaaattccatgatcacaaaaaggcactgattgcaccacgaagatcagctgtgatggccttgcatgatgagctcggtatgtagcgaagatacgcttccaaatttggggaaacattttagattacacattaactatctccaagcgccatagttgtcattcacaagctggtttggtatcaaagctgctcaggcagattgcaaaagcttggaaggctgaaagtggatagcgataatccatggtgaagatgtcttttccaattttcccaaattgtaaaattaccctttcttgatctgcagaagacacattgtgaaacgattcaacagcagcgacaagttggaagttcttaacagaagcaacagtgacacgacctctgaaatttaagcaccagcactgtagctgctcatgccatctaggggccttgtttttaagaaccaggggctcttctgaaccttgggttagtactggtgattgagaggggcttggggaactaatatctgagactgattccttcccttttgaagttgacaggtgaggaaactggccaccaaatgtctctgttaatgaagttagtgttgggacagtgcccccctcctcaatggaagacattggaatagagtgcatcatgcaatgcattctcctcggtcctcttgagcgaagaacattgagctcataggtgatagtgcctatactatagttacatgcaggtaatcttggagacacctgcctagaatggaatctgcgacttatcc

SEQ ID NO: 17762 - DNA, 646 bp, Populus trichocarpa
  Predicted polypeptide sequence is orthologous to G2592, G2713
ttttttttttttttttcgtcgaattgcttgatgattagacgtgtctgaacatagttttgtaatattacaagaacgaagtttaacaatatatgaaaacatgatggaatcattcaaagcaaactaatccaactgaaacatgagaaaagggtgacaaaggaaagacccctccaatgagatgcggttttttgcactttacagtccactacgacttgtacagtgactgcatacagctacgaccaccccatcctagagagccctaaaagaaataccttgccaattaaatgtttctatagtcgataccattctctttttttctttattcacaagccaatttagtgtcaaagctgctcaaacagattgcaaaagcctggaacgcagacaaaggataccggtaatccatagtgaacatatccttaccaaccttaccaaactgaagaatgatcttgtcatgatcagactgaacaggctgtgatggagtcggtgcaccagcagcaggttgcgttgcagcaataagctggaaattcttgacagatgctactgtcactctcccacggaaattgaggcaccagcactgcaactgctcatgccatcttggtgccttgttccgaagaacaagtggcctctcctttccctcttcatcttctcg

SEQ ID NO: 17763 - DNA, 884 bp, Populus trichocarpa
  Predicted polypeptide sequence is orthologous to G2592, G2713
tccggcttgttcttatgaacttgatttaatcaaatttcaagtccgcctgtacctgctgatggagccgtctctagagagagaaacaagagagagaaaacagatagagggagagcgatagtgttgtaaagttgtgcactcgtgttctggtttgtgatcatccatacacttgactgtaaatataattcatgcgatcacattgaagcgtgtattaacttattctgcaagtatattagaggaaatgtcattccgtagtatagttcgtgacatgagggatgggtttgggagcttgtcgaggcggagttttgaggtcaggctgccaggtcatcacagagggaaatctcatagctcagcttgtgagctgcatgaccagccagtggtcatccagaatagtcgttgggctggtcttcctcctgagttattgcgggatgtgatcaagaggttggaggctagtgagagcacatggcctgcccgcaagcatgttgttgcttgtgctgctgtgtgcagtgcttggagagaaatgtgcaaagaaattgtcagaaatccagagttctctggcaagatcactttcccagtttccctaaagcagccagggcccagagatggaactatccagtgcttcataaagagggacaaatcaaaattaacttaccatcttttcctttgccttagccctgctttgcttgttgaaaacgggaaatttcttctgtctgcaaaacgtacccggagaaccacatgcacggagtatgttatctccatggatgcagataacatatcaagatcaagcagcacttatattggaaaactgaggtcaaattttctgggtacgaagttcataatttatgacacacagccgccatacaacaatgctcagctttcaccacctg

SEQ ID NO: 17764 - DNA, 867 bp, Populus trichocarpa
  Predicted polypeptide sequence is orthologous to G2592, G2713
ttttttttttttttttttgacaatacgctgagtaaaatatatatacacacagcattatagatgacacttccggtcctaaattataaatgccacatctctttctacatcttgataggagttagaatccacgccatcatatcaaaaccttcaaacaagcaagcagcatatctgcatttcatttgcatatccgtcacccccacaaactttattgcaccgccatcaacggagaaaactccatcccacctggacatgcatgacagaccgaaacttgttgatggccaggaaaaaggctgctagcaggtggcactaaagacccatcactggacatatagccccgatactaatcttcaataaagagatgcctccgatcaagcttctgctcaatcatgagtcatcattcacaagctattttggtgtcaaagctactgaggcacagtgcaaatgcttggaatgcggagattggatagcggtaatccatggtaaacaaatcctttccaactttgccaaattggaggatgatattctcatgttctggcccagctggtccattttctggggaaacaaccaactgaaagtttttcactgaagcaactgtaacccgtccatggaagtttaaacaccaacactggagctgttcatgccaccttggagccttgtttttcagcaccaaagctccttctctctgactggacaaggatcctgattgaaagctctcaactcggtttgactttgaccggaaaaagggcagtgatggtaagaaatctacattgtgatgagaaaactcggtctgtgtgggagctattccaccaggttcaatggcagaagcggggatggcatccataatgcaatgcattctcctaggacccc

SEQ ID NO: 17765 - DNA, 602 bp, Populus trichocarpa
  Predicted polypeptide sequence is orthologous to G2592, G2713
ttttttttttttttttttttaaaaaaaaaaaaaaaaaaaaacgctgagaaaaatatatatacccccagcattataaatgacccttccggccctaaattaaaaaggccacatctctttctacttcttgataggagttaaaatcccccccatcatatcaaaaccttcaaacaagcaagcagcatatctgcttttcttttgcatatccgccccccccacaaattttattgcccccccatcaacaaaaaaaactccctcccccctggacatgcatgaaaaaccgaaacttgttgatggccagaaaaaaggctgcttgcagggggcactaaaaacccatcactggacatatacccccaaaactaatcttcaataaaaaaatgcccccaatcaagcttctgctcaatcatgagtcatcattcacaagctattttggggtcaaagctactgaggcacagggcaaatgcttggaatgcggaaattggatagcggtaatccatggtaaacaaatcctttccaactttgccaaattggaggatgatattctcatgttctggcccagctggtccattttctggggaaacaaccaactgaaagtttttcactga

SEQ ID NO: 17766 - DNA, 886 bp, Populus trichocarpa
  Predicted polypeptide sequence is orthologous to G2592, G2713
ttttttttttttttttttagtatacaagtcaagcttgcatcttggtgtctcaacaaataattaaagtgacaaatagttacacagccacaaaaagaaaacaaataaaaaggaaagaaagaaagaaaacaaataaaaagaaaataaaataaagaaaattgaagaaaataaaaataaaagagaagaaaacgcagaaagtgaaatatacagagcattataggtgacagttccagtcctaaactatagatgccacatctctttctacatcatgaattcttgatgcaagtcagactccaccccattatatcaaaacattcaaataagcagcagcctctgagcatttcatttgtattagtaactaccagatattcagttccctcacaaactttattgcaccacaatcagcccagaaaactccattccacctgctcaatcatgtgtcatcattcacaagctattttggtgtcgaagctactgaggcaaattgcaaatgcttggaatgcagagattggataacggtaatccatggtaaacaaatcctttcccactttgccaaattgaaggatgatattctcatgttctggcccggctgggccattttcttgggaagcgaccagctggaagtttttcactgaagcaactgtaactcgtccatggaagttcaaacaccaacactggagctgctcatgccaccttggagccttgtttctcagtaccaaagctccttctctctgactggacaagggtcctgattgaaagctctcaaccctctcaacacggtttgactttgaccggaaaaacaggagtgatggaaagaaatctgcactgtgatgatagaactcagtctgtgtgggagctactccaccaggttcaatggcagcagcagggc

SEQ ID NO: 17767 - DNA, 824 bp, Populus trichocarpa
  Predicted polypeptide sequence is orthologous to G2592, G2713
ttttttttttttttttttcgcaagccaatttagtgtcaaagctgctcaagcagattgcaaaagcctgaaatgcagacaaaggataccggtaatccatggtgaacatatccttgccaaccttaccaaattgaagaatgatcttgtcatgatcagactgagcaggctgtgatggtgttggtgcaccagcagcaggttgtgttgcagcgataagctggaaattcttgactgaggcaactgtcactctcccacggaaattcaggcaccaacactgcaactgttcgtgccatcttggggccttgtttcggagaacaagtggtctctcctttccctcttcatcttcttctcgaggaccaacaatgtcagaaaaacgtgaactgctaaactcagttgaattgtcaattgatttagaaaaggaaatgctcctaaaagagtcttcaaggcagcgtgggaggagctcaggctggcctgggacagaaccacctggctcaagggacaacgcagggattgagtgcatggtgcagtgcatcctccgtggacccctggtgccaagcctcgtgccgaattcggcacgaggtattgccataacttttctaaatcatcaccatcccatcattgttatcgttattttcttaacagaacagacatctctggagggtctcgaattgaatccttcttcggtcaagttgttaaaacccatggatcagcaaagcatttgcctgcatcatgcacttcaaaaacgagaccagaattgtgtttcttcccacaatatgtggcacaggccatgcgaacgccactttttataatcaactcagcctatgattcct

SEQ ID NO: 17768 - DNA, 599 bp, Populus trichocarpa
  Predicted polypeptide sequence is orthologous to G2604
ggactggattctttgttcttgaagctctccaagcttgtttgtttctctaaatgatatccaacaaatattcttgcatggcaaaaatgggagaaatggctgtgctttgtgtgtttgagactatgtaagcttgtaccaaatcgaagaataaagattagctttgtgaggttttgcaatgccagttcctcttgcaccttatccaacacctccagccccatatgctcctcctgctccagctccagctcctcctcctcctcctccagccaacggtgcacagagccagctcgtgtgttctggatgtcgaaacctgttactctatccagttggagcaacctctgtatgttgtgctgtttgcaatgcagtcacagctgtgccacctcctggcacagaaatggcccagttggtttgcggaggttgccacaccttactgatgtacatccgtggagcaacgagcgtgcagtgttcttgttgtcatacagtcaatctagccttggaggcaaatcaagtggcacacgtcaattgtgggagctgcaggatgctgttgatgtaccgatatggagcacggtctgtgaaatgtgctgtttgcaattttgtcacaccag

SEQ ID NO: 17769 - DNA, 890 bp, Populus trichocarpa
  Predicted polypeptide sequence is orthologous to G2639, G2640
ggttcttgctacccagcaagacaagtatcatttgcgtgtgtgtgagcaagtccacctccatagtcagccacccaccacgtgcttttctttctcttttctcttttcttttcattcctccagtactgtttgctagtaaaattgacgataaaaaaaggtcacatgaaattaattagcaaaaaattattttctttgtctcacttatttaattctacttgaaatatcatttgctttcattcgaactgattttcttcaactctgagatgaattagggctggaattgacagcatttccaccagaggtgaattcagatgccatatttcgttgcgttaaagtaagcgccatggacgatgcagatgatcagttggcatatcaaacggctgttaacattggaggccatgttttcagaggaattctctatgatcaaggtgcagatggccgttacgccagtacaggcggtgagagctcctccagtggagcacaacaacttcttataacagcagcaggaactagcaccacgggaactacaacaaacactagcaatccagctgctggcaatactttgctcgatccatcttctctatatccagctcctctcaatgcttttattgctggtacgcaattcttcgctcccccaaggtcctagctgcattctaaacaaaacctatctatttgtcaaagaactccataaataggtggtcttgttgtagtagaagtttttcatttttcagcatgcatgcactcgaaactgaagtagagagagcatagggattttagaaattagaaatggaaacattgcaggaaggagaatgtggatgtttttttttttgaattttttttcgaatttcattcagattcatgatatgggtttattttatttgatcctatcgatg

SEQ ID NO: 17770 - DNA, 931 bp, Populus trichocarpa
  Predicted polypeptide sequence is orthologous to G2639, G2640
ttttttttttttttttttgggaaaaagaagaagaataataacttagcattgaaatttgcacaaaaacaagaacatgttaagcattgcctctcatcagtcctcattcttccttttttctttttttccttaactcctacttgaatggatgtgtcaaatttacttctcttcttactacattttatcatcatcaaatattttttttgcccaaaagtacatggaaaaaaagagctcgctaatataaaagagagagaaaagacgagaatgacgttgtgtgttttcatgatcttggattcggaaagaattgcgtaccagccatgaaagtgttaagtggggcgggatataaagaggaaggatcaagaaatgaagctgtagtagacgccaccgttacaccaccaccaccaccaccaccagtagctgaaattgtggcagatgttgtggctgtgccagctgcgattaaattgagtggctgtactccaccaccaccaccagaagatgtctcaccaggtgccaagtagttgctttcagggccacgatcataaagaactcctttaaacacatgccctccaatgtttacggcagtttgataagctaacatctcctcgctttcatcaatgccactcactctaacacaacgaaataatgccggagagctcacttctgctgggaaattcccaagttctaaccctgacatgttattagccaagtgagtgcaagcaagagaagaagggcttggattttctctctgtcgtttaggattctctccgcgaatttgcagttgttgctgttgctgctgctggaaaatagttaattgatgctgtctttcacggcgtttagaggcaggaacccaagtgcttttcacatgggtttgacactcaaatcctctactcttacaacaagtcctacacctcatgtgtacacaatctttctttgc

SEQ ID NO: 17771 - DNA, 887 bp, Populus trichocarpa
  Predicted polypeptide sequence is orthologous to G2649
gtcaactcctaataccctcaccaccaccaaaacatggccgccgccgccaccacatgcagccaccactaccaccttcccacctgaccatccaaacatgttaggccttcacaatattctctttatagctccaccaccatcttcttgtcaccaccagcagccaccacacgttccctctactcaccaaataaccaataccaatgatcaatatggcattgcagacaatcaagagtcttggaacactctaaagaaatacccgcaagaatcaagtttccttgaaaggggaactttaaatgctcttcaggattgtgatactgcaataaatattggtcctgcaagagcatgtagggactgtggaaacagggcaaagaaagagtgtcagtacaggaggtgcaggacttgttgcaagagtagagggtatgagtgtaccactcacctgaagagcacatgggtgcctgctgcgaggaggcgcgagaggcttggttatagtagcggcggcggcggctcctctgcttcttcttctggtggtggctgtgttggtggtaaaagaccaagagaaaatgtgcctgctacatccaatagttttagtacttctaataacaatgctgctgcttcttttgttttggatactggctctagtttccaggatgcaagcttcaaacagtccttaccagttcaagttcacgccccagcagttttcaggtgcgttagagtgtcagccattaacagtgatgaagctgaggttgcctatgaagctaaggtgaatataagcggtcatgttttcaagggctttctttatgatcaagggatggatgagaaaaacctgttttcatgtatttcaaaaatgcattccagtgaaagaaatagagactcgtcctcgccaatcgttg

SEQ ID NO: 17772 - DNA, 719 bp, Populus trichocarpa
  Predicted polypeptide sequence is orthologous to G2655
ttttttttttttttttttgaggctgaaaacagtaagatcttaaagagaggaaaaaggttgagccgtagaggttaggagagagtattagtacaaactagaacaaaaaaatatgcttgggcaaggcattaaagatggtttgaattgaccaagcatctatgtgtggctcatacacaagatgctctagaaaaactacaaaaagaaaaaggtggagaaaaaagttacaaaatagaggaacagaaacatccaaattagaccaaccagactaagctacactaggaataaaatgggagagacattagtcgcgatgagcctttcagagactgcctaaaaatgcagaaattgccctcatatggtgtgtagagggccaaccacaaaggaaaattaatagtaaactttctaacaattcagcacacactcttcttgaatcctacctagcatctgatacactgctgtagcaatctcatccactgaagtcagcttacaatcatcttctaccttgacacttagagaataaagcacaatttgatcaaccgttgtgacgtttaggtgaagaacagtgaggcgcatgctatgcagcccagaaacaaccttcaagagctgtttcggccgccttttcgatcttattttgaggttggcatgactctctaccatggtcacttctatgtcagctatagtagattgagtcttatgcaacttttcattcttgccaacagagtttc

SEQ ID NO: 17773 - DNA, 864 bp, Populus trichocarpa
  Predicted polypeptide sequence is orthologous to G2655
ttttttttttttttttttcgcatgggcaagacattaaagaaggtttgaattgaccaagcatttatgtatggctcatacacaagatgctctaagataactacaaaaagaaagggtaaaaaaaagttacaaaacaaaggaacagaaacatccaaattagaccaactagagaaagctacactaaggataaaatagcaaagacattagttgcaataagcctttcagagactgccaaaaaatgcagaaattgcccgcatatggtatgtcgaggcaaaaagagggccaatcacaaaggaaaattaatagtaaactttctaacaattcagcatagactcttcttgaatcctacctagcatctgatacacagctgtagcaatctcatccacagaactcagcttacaatcatcttctaccttgacacttagagagtaaagcacaatttgatcaactgttgagacatttaggtgaagaacagtgagccgcatactatgcagagcagaaacaaccttcaagagctgtttcggccgccttttcgatcttattttgaggttcgcatgactctccaccatggtcacttctatgtcagctatagcagattgagacttcatcagtttttcatccttgccagccgagctttcgcaatgaattgagcttgttgtgtactgtggaaatataaagaatttagagaaaggcagtgaagaaacatgttgctgatcatcaccatttggtttttctttcatttctttacaggcaccaagaacttgtaacttttgttcaagctccttgacaaaattaatggcgcctccaataattgaagcttgatcacccctttgaacgtaggactcaggcattaaagatctcagaact

SEQ ID NO: 17774 - DNA, 459 bp, Populus trichocarpa
  Predicted polypeptide sequence is orthologous to G2717
ttttttttttttttttttctttgactaatacgtgtgaatgttttttttactttaaatttcaaaagcaaaccagctaattattttgttacagaaccacttataaagggctggcttctcaaacatttcaaaacaaatcattcagaaaagatgcagtgataaagtctaccatcttgggggtggtccttcctttcagtgtcttcctagctgtttcagcaaatgcttgtgctgcctctgcgtcagcttctgctgtctcagcctcccttgttgcctcttcagctactgctatggcagcttctgcctccgcaactgctcgagctgctacctcagcagcctgttctgcagtcatagtcctcatcctgcccagatccaagtcaatctgagacattgtaaacatattgaaaccatccctttcaattttaggagagatcctctgtcttccttccaatagtaagggagaac

SEQ ID NO: 17775 - DNA, 744 bp, Populus trichocarpa
  Predicted polypeptide sequence is orthologous to G2747
ttttttttttttttttttggacttttaattaatatattatatagcaataagttaagtcactactaaaggaaaaacaatgatggaaatattcctgatatttatctgtatatatgtattatacacagttgaaggatttgtcgaactccacatttcttgcacctctcttccatctcttgctcttcacaatatacccaaaaccgcgtctattaatctaccgacaatatttaaacaatcgacaaaaagaaactcaaagaaggctaaaacttataaattgctagaaacgaaagaaatgggatcttcatcacttgatgtgcaggtgtgatcaaagatccaaatcaaaagataaggaagcctttcctttctttgaaaactcagcttgcattggagcaccagtgggttcccttacttggaaaggaggagggagagaagaggaagccaaacgaggggagagtgaatccaatgtgccatgtctgatcattgtaaccgaagatgacgggtcattttgtgtaggacactccatgtttacaccaaacagcctgagccgcttccccacagtcttaccatgaacaactggcactgagtctatcaccacctggcacatgacttcctccttgttcatgcactgccccaattggaagtgtactcgccggcggccttaagtaatactgcgctgcattgccataactaatgttggacggttgatgataatgatacagaagattatggtgttgatgttgttgataa

SEQ ID NO: 17776 - DNA, 913 bp, Populus trichocarpa
  Predicted polypeptide sequence is orthologous to G2763
ttttttttttttttttttggggaaggattttaattaacaactttattattaattaattaattaattaattaacagtttttctaggattcataacagagaaaatagaataccttttttcttaaagaaaaaaaaaacagagacacgtatttaacaggagtcaaaagaaaaaaaaatgtgggaaaaaaccagaaaacgacatctggcaacacaatcccattaggaggtcatcggctcagaagtagagctggcttcggaggtagagcgagaaagaagctcagctatagcagtcatggttttaacttgcatctccaaagcagcaatataatctgtagcttcttccaaaataacaggcaatggttgtttcaggcaaccaggaactaaccggccaagaacacgaactttcctttgaacagccggcaaacccttcgctttcaacctcaaaacactcactttatgcttcctcgacgaccggctgctactcccggtagtggatcctggagaagaagaagacgacgacgcaagtctctgtctcttatgttgttgtttccgaaatttgagtttgatgcggctagttaaaatggctcggctccacctggttttacctttagcagcgaaagctaaagcccgatcagcaacttctctaacggctcgaccttgacgcggggctgatgaagttgaagggttgagattgacttggcttaaggcttggatgagtttggatgagtagacttgttgttgtgcttctgttttccatttggcgtggctctgtgagttttggttctgttttgattggtgttgctgcaacactgatttcttcttctttttccttcttgttcgatccgtggtgatgtttggcgtagtactcactattgctgctgctactgctgacgacgacgatgggtccatcttcaat

SEQ ID NO: 17777 - DNA, 909 bp, Populus trichocarpa
  Predicted polypeptide sequence is orthologous to G2763
ttttttttttttttttttcttttttttttgaattctaatgccctagctagttcttataatcaattaacatttcttgaggattcaaaacaaagaaattagaacactgtttttttccacaaaaaaaagaagaagaggaaagacgagtatctaacggagctagaagaaaaaatatatatgggaaaaaaacagaacacgacatctgtcattacaagcctatcaggagctcatcggctccaaggaagagccggctccggaggaagagcgagaaagcagctcagctatagcagacatggctttaacttgcatctccagagcagcaatgtaatctgtagcttcttccaagataataggcaatggttgtttccggcaaccgggaactaatcggccaagaacacgaacttttctttgaacagccggcaaacccttccccttcagcctcaaaacactcactttatgcttcctcgacgaccggctattactcgcagttgtaacaacagtagatcctgaagaagacgaagacgcaagtctctgtcgcttatgttgctgtttccgaaatttgagtttgatccggtttgtcagaatggcccggctccatctggttttacctttagcagcaaaagctaaagctcgatcagcaacctctctaacggctcgaccttgacgtggggctgatgaagatgaggggttgagattgacttggcttaaggcttggataagtttggatgagtagatttgttgttgtgcttctgttttccatttggcgtggctctgggagttttggttctgttttgattggtgctgttgcaagagggatttcttcttctttttccttcttgttcgatccgtgttgatgttggcgttcgtattcactgctgctactgacgttgttgttgatgatgccatcatcat

SEQ ID NO: 17778 - DNA, 669 bp, Populus trichocarpa
  Predicted polypeptide sequence is orthologous to G2765
ttttttttttttttttttcagacaagccgtaataagcagatacattaacaaataccaggtcccataacttagtcctccctgcgggctatcttctactctagtggacattaggtatttgtatatatagtcatctttccgccttttatgtgggcacaaatattcttcattttatggaacacattttccagtgtatctcattaaaagcagcgcaaatacaagcctgagactaatgagtgaatcatctccagcattcatttacatacagcatatgcaagagtgaccaaaaacaaagcgcacactacacgcattcccttttgcaaaaagaacatcttcgcctcaagtctttccactcgagcctcaacatttgccatccgtgcctccaataaagctacccgagcctccaaccttgtatctacatgccctgtgttatttctagtacgttgttcataatcttcaatttgtgctgaatcatcttcccatggtcgatactgacacatttcaattcatggagtttactcgacgacgcagagaatgatgggcgagatccttcttgacgcgaaatccccagggagaattatttttttgggctgtcaaaaccctagagaaatcattggattggagcttctaccaggaaagaaaggacgggattaaagggagtgacggtcaggc

SEQ ID NO: 17779 - DNA, 894 bp, Populus trichocarpa
  Predicted polypeptide sequence is orthologous to G2766
ttttttttttttttttttcttttttttttttttttttttttttttttttttttttttttttatttttaaatacaaaacactttaaaaaataataattaccacacttacaaacaccaaacaacaccaaacactctgttgactcactcattgatacattagttgaccaggcaaatctactatccaaatcttggaccatcccgacaagatttgataactatgctctcaattctcaaataccaagaaaacaaaaaaggggaaattaaacagcatttttacatgcatcatttctgattaaactacaagtcaacaatatcactccactatatacagttttgggtttgattccctaacgttacggttgttaaccgaaatttggtaagataactttagcctgcctgagtccctgccttcaaattccttgaatcaaaaacttttttcacatttatgtcgggtcaacgttcatcccatttcagccgaacatcatggggctctaataaacaatctaactttcggttgccttgccgtgaagtgatgatttttcacacacagagcaaaaaattgcccatcgctccaggctcccatttttcacacaatcatggggttgatttttcgcatccacaggtacaattttccatttctttgtggagtttctccacctcattttgaaggcctttgatatgctgcactgcgaaatccagcatgtctgcataacttgtttgcttatccatgttcggaacgagatcttgtagtttcttcagtttcccacttattctggttcttctctccctttcagcaatgcttcttggatgagtggcaaagccacgcttagcacggattttgcaaggaacagagtcttcaggaacatgtagcagcttctccactgtttctatctca

SEQ ID NO: 17780 - DNA, 886 bp, Populus trichocarpa
  Predicted polypeptide sequence is orthologous to G2766
tttttttttttttttttttaaattatctcaaagtagtgataatataatacactagcaacttgataataagaataatgataaaaaaaaaaaacaaaaaataaagtaaaggttcccacatgtttgacaagttgcttgtcacactatacattgcacaagattacaaaacaaaaaggtcacctcaggctcaggttcaggctcaggctcaggctccgtagggtgacgcaacaactagtctttggacatttcccgaacgagccaatctccttcctcgaaatcaaactttcctttcccatattatcctctctctctctctctagatttttaactaccatagttatttttagcagtagcagcctacagtagagtcgtgggaagaagcctgcgcagcacgcatcatgtatcaacaaccgtcgtcgtcttcttcttcaccgcaaaaatccaatctgccaagtgggctaacaaggtatggttcggccccgggttcttttttaacccgagcagttgattcagtcatcggggctgaccgtgaactctctggtcttggatcaactccccttgtgggccgtcaacaacacttctctggggactcaccctccatcacctcggagtcgacctgcaaagtcaactcatccagctgcgatcgaaaagcacccaaaagtggcggcggcggggggttgcagaggtcgtacggtttgaatgagatagcacatggtgctggatctttggtgcggcagaggagctcgcctgctggatttctaagccatctcgccactgaaaatggtaagtatacatacatattttccttaaaataaatacataaataccatcagtctttatctttgtggattggattgatacggtggacaggagtagatagattcttgat

SEQ ID NO: 17781 - DNA, 886 bp, Populus trichocarpa
  Predicted polypeptide sequence is orthologous to G2779, G2859
ttttttttttttttttttggatcaaatggatgcttaactgctcatgccgacaaagcagcatcaatacataggatgttaaacaccacaaatcactatagaaggtcaaatttgaaaaaagagagaaagaaattagccctcgaattggacaagtaaatagcaatataatctctctttttttgtactttatttctggacctttttgtgaagtaatgcaaatatcattagcatttctgccacataaatagacatttgatttgcggcaaagggtgatagctagggaacatattcttgtgctttatagcaacaaagagtaattgccaaaaatgcagtcaaatggaccatgtagagtggaagcaagtgatttctccatatctttctcttgaccatttctgtgtctcctgtgcgtcatcagttgaatttgttccctgagccttcttggaagattctgtgagatttttcaggtcattagaacaactggcagcggcaagctccatggagagaaactcaacttgattctgcaatgagtgtacataattgattatctcctctagcataactgccatccccattgacttgtggcatccaggaacaatgtcttgcaagcatcttaatttgttattgattttctctcttcttatcctttctgctatactgtgactgtctgttgcctggcctctcttagctctaacatgaataacttcctttgatttgtccccttctttctccttgtttttgcctttcttacctcttcctaagttattctttttctctgtgatgtttatagaggctgtaggagaaacgttcttggagctgccggttgattgttccattgcttttggcttcttcctttcatggaaaacattttgattcaagctgacagaatgaa

SEQ ID NO: 17782 - DNA, 907 bp, Populus trichocarpa
  Predicted polypeptide sequence is orthologous to G2791
ttttttttttttttttttacataaaaacgtacagtcgatcttcaaacaagaaaggacgatgaaagagagacaagttctaaaagtttaaaagtttaagtagctctagattccaagattatctgcctcagcttgaaaaatgaaaccccatctaaaataatgaaattacatctttactttccgtgctctagaaatgcatcaagtgttcttcagcacttcttgcttgacaacctcattgcagccattgacaatcatgcctttgctgctaagtgtaccggttgcaatattgttatcattggacattggatgggtgtcaatgccagttatgctgctgctgctgctaacaagaccactggtgtagccattgttcttcctctcctcagaagttgtacctgataacgatgccttaacactggatatggcagcagcaagagcaatgggcatgaggcagagacctttgctttgaagatattgcatggccatggtcacatcggattccagtagcttaagtacttcttgctcaaaggcaatctgatcagcagatggagaaatatcaattcctagaccagctgatggagagagcgacaaactattatgaccctcaggttgaccatctgtgaggagaggaatgactgctccggctgcccctaacctgctcatgcttagcaccttgacttggagctgaagaaatttgacatactctatgatctcatcaagcatagatgccttgtcaaccttattggaattaggtacaagttcttgcagattcttcatcctttcagcaattttctctcttcgaagcctttcagctatactatgtgggtcagtggcatggccacgtcgtgctcttacacgagtttttccagttccattgcagccttctactggagcagctgatgtagtctgaggc

SEQ ID NO: 17783 - DNA, 890 bp, Populus trichocarpa
  Predicted polypeptide sequence is orthologous to G2791
ttttttttttttttttttctttaaaatcttaaaatactactgggtggtggtgacgtcatgggagggagatccaaactgggataggaaaaaaaaaaagaaataataatattaaagttgcaaataataaaataaaaaaatgtaacaaaacctaacccctttcttaaaacacaaacaacggcagtaagttgttcttgggacttggacggtcttgttactttgttcttgtttttggtacttggtggtgttgttggggttagcttaagccaaagtctacgtaaatacggcgtcgtgtcatccactaaaacaccagacccttattttagtagactttgaaacggaagatgaatcctacacgtcacacactctctcctccccttttctcactttgacttttttctccctcaacttttttattatttactctaatagtaaatcccgaaagtcagtcaacgccgttagatcacggtttggaaacggaagcagcatctttaacagcgccaccatcacctccaacgttaaccattgtagccgactggacggtcaaaacagacatgctgggtgaggctggcccttcgccgttggattggagcaaagcgtggtggttgttgttgatcgcggggctcctgttgtgacaagtggcggttgagatagcggttgcgagtgagatgggcatcaaacaaagccctttcccttgtaaatactgcatggctgagcccatatcctcttccatcaacttagccacctggtgctctgtcaccgtcaagctgctgtcgttagttctggccgtttggttgccgttagaggtacgggagagggacccaccatcggcactggcctggatacagtcaccaccagcctcagaggacatgtcagcaacaaggggggcaacg

SEQ ID NO: 17784 - DNA, 930 bp, Populus trichocarpa
  Predicted polypeptide sequence is orthologous to G2846
gaagctttacctcaaagtctcaagctgcaataagaagacacgcaaagattatcaatacaaacaagtttgtggccatggcagaggagtttcaggccgggatttgtggcgagaactggtggatgaattcttcgaaaagcatgttcatcggcggcttatcaccatgttctacggtgagcctccctagtgatcatatgggaacttataatgggtcatgggccacggctgatatggtagacttgaagccgaggtcaatatcatgcaaggagtctcataacactacttcggtgtctgatacctctatagctttcctaaattctccaaagcctcaacaggctaattcagatagtgggggtagcagtaatttgattgattccaccttgcaaatgatggggttcgggctctcgtcgtcgtcgtcgtcatcggattggaaccaagctttactctctgggaatggaagaactgagagttacaattccatgctgcaagaagacatgaattcaggaggactaaactcttctcaaatccgaaaagattggagtccaaagagctatgcaagaactgctgaagatttctccttggaccaacaaaggctaaatccagttaacagttccagcaattcgccaccaacttgccagggattttctacaggcttttcaatggagccaacagcttcttattgctacccttcaacattgatacaaagtttatttgaaccagatcatcttcaaccacaacaagtacaatctcttttcaacaaccggcccatgaattacctgtcgccgacagctccaaattatgggaccaacatgagtgaattgtcatctccttcttggactaaagtatctcccttgataaaatcttgtttgcaaaagcaacaggctagtagtttgcactttactaaaacacacacctactggaatgcctcaccaa

SEQ ID NO: 17785 - DNA, 213 bp, Populus trichocarpa
  Predicted polypeptide sequence is orthologous to G2847
ttttttttttttttttttgatcctttagacaatatttgtggaaaccaatgtttggtttcaagcattacattaccgtcttcagcgaatacctggtctgtgtacactttcctgatatcccaacaccttgatggacacgatcgtttcaaccatggcaggagtttgtaatactaaggcactgtttgttttcaggtgcaaatatatttttgaaaaaaa

SEQ ID NO: 17786 - DNA, 914 bp, Populus trichocarpa
  Predicted polypeptide sequence is orthologous to G2851
ttttttttttttttttttcgtagcagctaaatgaggaagaacatagatagattataagtcttgatcttaaatcagagtgttcaaattaaagacattcaggtccaaactagagagcacacacagatagcgaagaccgcatatagcatcatgagcaatcagccttagatttgagcagagtgactgctaatgatgttatatcattttatgaagctcctcgtgtgcttaaacctcccaccagaagattgttccgcctatcggaacccccctccaagagcgggagcccagtagtctgctccattatcgctgccaacttgcagtgtgcatgacactggaacaagacacaatcctctactcctcaggtcctttggctccccgtgagagtcctgctgagaagctcctttcctctttatgcagctatcattcaacagctgaccggggtcctcaggaaatatacagttgctttctccttgaacagattgttgctgcctcatatttgtggatccactgcccaagtacggtaagctgagagcctcaatttggctctgaaggaatctgatgtacccaatagcttctaacaagacagaggccgtgtcagtcttcccaaatggagaaacaagctggtgaagagcggtaatcctatcacctaatttctccttcctcaccttaaaggtaggttgggcggaagaagattgaaccctagctttctttactgccccaccattagcggtgctgttacaatcagaagatcgatctggtggtggatgccttccatctcctttgctggtagagaaatccaacatgttactgctgaaactggtaacacaggacttgggggatgaagcaggtatcacttgagaacaagctgtaggttttgcagctgcctggaaatcttcatttgcaccgtacacgtagtt

SEQ ID NO: 17787 - DNA, 853 bp, Populus trichocarpa
  Predicted polypeptide sequence is orthologous to G2851
ttttttttttttttttttgaaagaaaaatgctaattaaacttcaattttcatggagctctataacatagctcgaagaaaacatcaacagacagaaagggtgagactagctagctagagggttcagaaacaattaatggccatttttaattagaattgcataccatcatgagcaattacccttggaatgttgcggcagagtgattgctcatgatgttatatcattctttgaaagtttgaatcagccttggaatattgcacccatcaaaaccctcctcccatagccggagcccaataatcggcgccgttgtcacttccaacgtgctgagtgcaagacagaggaaccaagcacagtcctctactcctcaaatcctttgggttatcttgattatcagattgttgatggttcctcatatttggtgaggcagtgcccaagtaaggggagctaagagcctcaatttgaccctgaaggaatctgatatacccaatagcttctaacaggacagaagccgtgtcagtctttccaaaaggggaaaccatttggtgaagaactgtgattctatcacctaacttctccttcctcaccttgagaggttggcttgaagagggctgaaccctagccttcttacatactccacctgtggcggtgctattacactcggaagattgatcgggatgctgattcgccccatcagccttgttgtaagagaagtctaatatattagtactacttatactcgtgacgcaagacctaggggaagagactggcatcacttgtggccaagctggggacctaagtgcctgaaagtcttcatccccatgaccatataagttgctattgtgggaaacctcttg

SEQ ID NO: 17788 - DNA, 651 bp, Populus trichocarpa
  Predicted polypeptide sequence is orthologous to G2851
gacaggttctcaaacctccatgatttaaattctctcaacaggaggactttcttctatttaatccagaacaggaagacccctcaaactttctacaaagaccctgcttaggagcttcaagaaaagggaggagaaataaaaaagagagatttattgctagtacaactagagtgaaagagatcatcatataccaagggggaaaaatatatattctgtaggaaggcaatgaatagaggggttttgcagagttcaccggtgcagcaaatgatggctggcaaccccaactggtggagcatcaacaatatgaggccaccaataactcatcatcaacaaccctctccttttctgcctcctcctagtctcttccctcaattcctaccttccatttcttcttcttcatcatcttctcttcctcttccttcttggaattatgataacccagatcagcttccagagtcatggagccaactacttctgggtggattggtgtgtgatgaagacaagagcaatataagcaattttcaagcaaagaagatggagaattgggaggagcaagtgttacatcaagcatcaagtgcttcggttatggatgtcaagcaagaaaactctgcaagcaactacgtgtacggtgcaaatgaagatttccagcagctg

SEQ ID NO: 17789 - DNA, 858 bp, Populus trichocarpa
  Predicted polypeptide sequence is orthologous to G2854
attaggtttgctgatgaaaatgaacaaaggcgtgccatggttgagatgaatggacaatactgctctaccaggcccatgcggattggaccagctgccacgaagaaacccttgacccagcagtatcagaaagctacttaccagaatcctcaaggaaatcagggagagaatgatccaaataacacaacaatatttgtcggggccttggatccaagtgtgactgatgacactttgagggcagtttttagtaaatatggcgagctagtgcacgtgaaaatacctgcaggcaagcgttgtggattcgttcagtttgctaatcgaactagcgcggagcaagcactatcaatgttgaatggaacccagatagctggtcaaaatatccgtctctcatggggccgtagtccttctaacaaacaggttcagccagatcaaagccagtggaatggcggtggatattatggatatccacaaggatatgatgcatatggatatgctgctgctgctgctgctccccaagaccctaacatgtattatggaggctatcctggatatggaaactaccagcaaccgggagcttaccaacagcaacagcagtgatctgtttccatggcgggattcaaaaaatgcaaggactgatgttaatcagtagccagagcaatctgaggttgcagttcactagttgcatggtgtttggagtttggcgttttgctatttgttctggtgttagtttatcagtgacaagtgtgctgtgggcaccatttgaggcagcatcaatgcactctgatatgatcagtatggttttgtaataccatggtgccgcaatttgcactatctgtctactggatatttcgtacttaaccc

SEQ ID NO: 17790 - DNA, 923 bp, Populus trichocarpa
  Predicted polypeptide sequence is orthologous to G2854
ttttttttttttttttttgggccacgagtgcgaaaaatccattaggcaaatagagcaaactttgaggcaccattacattacaaaaccatgatcatatcagaatgcagtgatgccccctcctcaccatatggtgcccacaacactgctaacactagaacaaatgtcaaaataccaaactccaaacaccaagcacatccatgcaactagtgaactgcaacctaggattgctctgctaccgattaacatcagtcctctcacatcgataccgcagtgtaagcagatcactgctgttgctgttggtaagctccgggttgctgttggtatgctccgggttgctgttggtaagctcccggttgctgttggtaagctcctggttgctggtagtttccatatccaggatatcctccataatacatgctagggtcttggggagcggcggcggcggcagcagcagcagcagcatatccatatgcatcatatccttgtggatatccataatatccaccaccgttccactggctttggtctggctgagcctgtttgttagaaggactacggccccatgagagtcgaatattttgaccagctatctgagttccgttcagcatcgatagtgcttgctccgcacaagtgctgcaggtattttcacatgcactagctcaccatatttactaaacactgctctcaaagtgtcatcagtcacacttggatccaaagcaccaacaaatatctttctgatattgctgggtcaaaggtttctttgtggccgctggtccaatccgcataggcctagtagagcagtattgtccgttcatctcaaccatggcacgcatttgttcattttcatcagcaaacctaacaaatccatatccctttgaacgtccagtaactctatcagtaacaacttttgcacctttcacgga

SEQ ID NO: 17791 - DNA, 679 bp, Populus trichocarpa
  Predicted polypeptide sequence is orthologous to G2888
gaaacaatacctgatgaagatgagtgttgcagcaaagaaaggaaaggaaaaaagctgatagaaagctgatgtaacaaaaaaagctgatcgtaaccgaaagaaaagaaatcaaagcaaaccaaagtaaaaaatatagcttttttcttctccttgctagctctctctctctctccccccctctcttatctcttctctctctagctccccacatattagaaagagagaagtaaagaaaagcatcatcatcatcatcatcatctactcttgcctgccacaagaaaagattgtttctttgcttcttcataatcacagtacacaagatagaatcagcaagaattaacccatgttagccaataactctctctcttcatcacttccttgtaattctgagccattttcttgcttggaaaatggaaataacattaacaagaggaaaagaaggccagcaggaacaccagatccagatgcagaagtggtgtctttatcaccaaaaacactattggaatccgatcgttacgtttgtgagatctgcaaccaagggtttcagagagaccaaaacctacagatgcatagaagaaggcataaagtcccatggaagctactaaagagagagaccccagttgtaagaaaacgtgtatttgtatgtccagagcctagttgcttgcaccatgacccttgt

SEQ ID NO: 17792 - DNA, 605 bp, Populus trichocarpa
  Predicted polypeptide sequence is orthologous to G2898
ttttttttttttttttttgccatcaactaacttttaagagggagtagatataggttggaaaaaaatttgcatataaacaataaagaccaaagtaatgcataatgatccagctgtctaatctgcgttgtgatcacctagatgcaattgccaggtagtaatttacacgagaatgataaacaaatggacaatttcagaggaaaggagaacacagaagtggtttgaaagtagatatacatttttccctcatgtactcctagtgaaacaacggttttcaaacacaaccttgaactctactcgtcaaactcagaggcatcctcagggtcttcatcttcaccgctttcctttctcttgatatattctgacgtggctctatcaaactccgccctcttttctgtggctatatcataatatttaaccttttcctcataggtcattgttttccacttttctccacatgccttgccaacctcacgcattgacttgacatctggattctgctcttggaattccttgcggaaatcctctaagaagtaaaagaaagcagttggaggtttcttgggctttttagcatcaaatttcttatttttcttggtcttcgactttgc

SEQ ID NO: 17793 - DNA, 932 bp, Populus trichocarpa
  Predicted polypeptide sequence is orthologous to G2913
ttttttttttttttttggcatgaaattaattttctggtttgggtcaatcctgaacgtcttgagctttaatattcagctccacttccatggcttgcctgagctgaagtttctccttgtactctttcagttctctcttgtatctttccttgtctttcaagccaatgttttggtaaaccatcctctcctctgcgctgagactgctccatgactggcctatcatttttgtaaactccctttctctattggggtaaagcgatttcagcttatagtgtttctcagcaaagaagaagttgtagccactcctgttgggtttggggtagctgggatcccccgatcttctgcttctcctcctccgacgcctgcggttgggagtgtatgggacaatggcaccatcatattgaggaatagaattagacaagtcctgctggtcaggatggtaaagcactccatggagaacctctgaacctaattgcaccgagaccaggtaaccacaatcaaatttcccttctattgtcccactggctgaaaaagacgaagagctttcggtagacggatcaggacaatcccttatgggttctggagaatattccacaatagccagttcagttttgcttgaagggctgccaagaggaaatgcaactgctggagtagagactggaccctggatcttgaagaagtggacctgttcgtaatgataaaggaggctaaagtagtgtttcttcaatacaaaagaagcacttgttgttgttgcagagaaacaaaacacagaacccacttccctccatttcttctctgcaacaaccttatcataaccacccctgttagttgtctctacatataaaacttgcaaatctagctccttccctccaatcacaggtatcataaaattggtgcccattacaaaatgaaagcgcctgagagtgtcccaaaaa

SEQ ID NO: 17794 - DNA, 900 bp, Populus trichocarpa
  Predicted polypeptide sequence is orthologous to G2969
ttttttttttttttttttggactatccatcaaaattataaaaactacaaagcagaaggaagggatcatacgctattatcatggtcacactcacacagtatatacaatcacaaagcaaggaagcacagcccttggattaaacaccaacagctcctcctcatccaacctggtgtggaccccactgccacctcttcccaggacagaatcagacccgccatcctgcttgtctacatcctcttccaggtcgcacccgacccgacccgcgacgacccggcaaactagcatagcgcgtttcacattcatgaacttgaactcctcttcaatctcctcaggtatcgccatgtgtgctctccaactagtagatagtgtagaaattccgtccatcttgggtgagaaaccagacttgattatcccacagacactgcaatattgctggttacaaatgctagaatcctcattcagtcctaaatcacacataaaggttgaacagtaaaacctcaagagctcgttaccatcagcaatgcacctctcgtctcctctcttactgtttcttgcagctttggctctaacaaactccctgtactcttcaaatcttgacagtatctttggactattatggatcttcaaaattctatggatttctgggctcttctctttacatgaccacccggttttaaaaatgatatggactatattcttgcctgaatcgccatctagaagctgtgtgacagcatgcttggtagcttgatgttgttcaagaagctgaggtttttggaaaatctcaccacaagcagtgcatggaaagatatcatttcttaaaggaaagaaatggtgatctgttgagatatcggattcctcgcaagacccacttgacttttttccgaggtggaagctcgggcag

SEQ ID NO: 17795 - DNA, 678 bp, Populus trichocarpa
  Predicted polypeptide sequence is orthologous to G2983
ttttttttttttttttcttgaaagtcttccaagcagtgcaatatatcaatttttcttggaacggtggaagaagacacatctcttttcccatttgaaacttaaaatatgaaagagtaggctcaagattggaactaggtgcgtggacttcagtgtccataggttactccttttaacctaaaaggtttgtctgaactctcaacaagttttttttgtagtcaaaacgatcacacacacccacaagagagatcgaataaagagtgacaaagagctttggttccaagtcagaaaatagggtacaaagagacaactacttgcctttcttctttctcgaaacaaagaaagaaagtaaaagcagatcatcgcaatgaaattaacaaaattgaatgagatttattttgtttttcaaaccccttcatcttccttccgggtgcaatgggaaaagctccagagttctatctccctcctctttacatgacctgctttcttctaattcaaagcattcaaatgaccagctcctacactttcttttgtatggactatcctcatctttctccacttctcccctagtatccaaagatataatggtaatgggagatggggttctaggactatggcttaaaccaaggctgtttctcttctgtttttgcctctcgcgggctttgtggttttggaaccagt

SEQ ID NO: 17796 - DNA, 825 bp, Populus trichocarpa
  Predicted polypeptide sequence is orthologous to G2983
gcgccatgggaagcatgaaggtgcatcagttggcacgtggattttgggagcacgaaccctttcttacgctgggtttcaagcgtttacgccctctcgctcccaagctggccaacacagatcatagtgctgcctctttcgatctcaagagcttcattagacccgacagtggccctagaaatcttgcctcttctgacgagaagaaagattcccctcagggggagacgcacccgggagggacacgttggaacccaacgcaagagcagataggtatactagagatgttgtataggggaggaatgagaactcctaatgggcaacaaatagaagatatcactgcacaactaagcagatacggcaagattgaagggaagaatgttttttactggttccaaaatcacaaagccggcgagaggcaaaaacagaagaggaacagccttggtttaagccatagtccgagaaccccatctcccgttaccattatatctttggatactaggggagaggtggaggggagaggaggatagtccatacaaaagaaagtgtaggagctggacctttgagtgcttggaattagaggacagcaggtcatgtagagagaagggagatagaactctcgagcttttcccattgcacccggaaggcagatgaaggggttgtaaagaaataaataaataaatcccattcaactttgttaatttcattgtgatgatctgccttgacgtgcttttctttctttagtttctttctttgtttcaagaaagaagaaaggcattgtctctttgtactctattttctgacttggaaccaaagctccttgtcactctt

SEQ ID NO: 17797 - DNA, 914 bp, Populus trichocarpa
  Predicted polypeptide sequence is orthologous to G2983
tcgaccatgggaagcatgaaggtgcatcagttggcacgtggattttgggagcacgaaccctctcttacgcttggttgcaagcgtttacgccctcttgctcccaagctggccaacacagatcatagtgtaacctctttcgatctcaagagcttcatcagacccgatagcggtcctagaaagcttgcctcctctgacgagaagaaagattcccctcagggggaaacgcacccgggagggacacggtggaacccgacacaagagcagatagggatactagagatgttgtataggggaggaatgagaactcctaatgggcaacaaatagaagatatcacagcacaactaagcagatacggcaagattgaagggaagaacgttttttactggttccaaaaccacaaagcccgcgagaggcaaaaacagaagagaaacagccttggtttaagccatagtcctagaaccccatctcccattaccattatatctttggatactaggggagaagtggagaaagatgaggatagtccatacaaaagaaagtgtaggagctggtcatttgaatgctttgaattagaagaaagcaggtcatgtaaagaggagggagatagaactctggagcttttcccattgcacccggaaggaagatgaaggggtttgaaaaacaaaataaatctcattcaattttgttaatttcattgcgatgatctgcttttactttctttctttgtttcgagaaagaagaaaggcaagtagttgtctctttgtaccctattttctgacttggaaccaaagctctttgtcactctttattcgatctctcttgtgggtgtgtgtgatcgttttgactacaaaaaaaacttgttgagagttcagacaaaccttttaggttaaaaagagtaacctatggacactga

SEQ ID NO: 17798 - DNA, 600 bp, Populus trichocarpa
  Predicted polypeptide sequence is orthologous to G2983
gaccatgggaagcatgaaggtgcatcagttggcacgtggattttgggagcacgaaccctctcttacgcttggttgcaagcgtttacgccctcttgctcccaagctggccaacacagatcatagtgtaacctctttcgatctcaagagcttcatcagacccgatagcggtcctagaaagcttgcctcctctgacgagaagaaagattcccctcagggagaagtggagaaagatgaggatagtccatacaaaagaaagtgtaggagctggtcatttgaatgctttgaattagaagaaagcaggtcatgtaaagaggagggagatagaactctggagcttttcccattgcacccggaaggaagatgaaggggtttgaaaaacaaaataaatctcattcaattttgttaatttcattgcgatgatctgcttttactttctttctttgtttcgagaaagaagaaaggcaagtagttgtctctttgtaccctattttctgacttggaaccaaagctctttgtcactctttaaaaaaaaaaaaaaaaaaaaaaaaaaaaaaaaaaaaaaaaaaaaaaaaaaaaaaaaaaaaagaaaaaaaaaaaaaa

SEQ ID NO: 17799 - DNA, 874 bp, Populus trichocarpa
  Predicted polypeptide sequence is orthologous to G2989, G2990
gtgcagaatttgcaatatactaaaaaactaatctcaattttttatacaaacaaggggataccaaaagtcgagaagggggtaccaaactcgagctatatatttagtccatcgtatgccaaaatttggtgataactttggaaactctaattagtctttaaaaaggaaggcgaaacttcaaaataagtcggttttggggttgaggggtaaccaacagactggattaattcctccacagtcagcacatgaaactttggaggtgaattaagagcaatgttgtcgacccgatgctgaaagatcttccccttgctgtcaagtttgtactcagacaggccatcacctcgtgccgaattcggcacgagggagcagtgcccttggcctttgccttgcacagttgtatccctctaatctatatctaccatcttatctcccacctcccaaaccccatttcccattacctcgtgagacattttggctttctaaacagataaatatcatcatcactgtattcccatcaacttcttcatccttcgtgtgtaaaaattgctctcaattctctacatgactaaaaaagccatggactcaaccacaagcccccaccacatcaccaaatcccctgactcggacacagatactgaaaccccactccaaacccatctcaccaaggccttatcccttacaaatggctcacacaagacccaccaaaatcgccatcttccaccaccaccacaacagcaaaatatggtggtgtcttacaaagaatgccacaaaaaccatgctgcaggtattggtggactagccttggatggctgtggggagtttatgcccaagtcaactgccacccctcaagaccctacctcgttcaaatgtgctgcct

SEQ ID NO: 17800 - DNA, 873 bp, Populus trichocarpa
  Predicted polypeptide sequence is orthologous to G2992
ttttttttttttttttttctttttttttttttttttttttttttttttttttttttaacaaaaaacataatagttatgtaaaaaaagttactgcccttttaactgtcatgcattctccactctatttctctccatgacgacctttaattagtgattagcaatcactgaacggtcatcaacatagctaaagaaactaaaaaacaaaaaaaaaaaaaaaaaaaaaagcaaaaaactttcatgcccactagtcgtctgtctgtcgtctgttttttcttctttatctaaatcaatacaatggaaaaaatccatggggagccataaaaccatgtacacggactttactctcaatctggtacctatcaaagctatcatagttgctcccattgttgttgaagctgcaacctttgttgtcagcaccaactctaccagcttcctcattagcgttaaaaccacacttgtcgctgctattaataccgtaactattattcaacttttctttcctggacctattgttatgcatccaaactttgaaaacatttctagtaaccccgatttcactgcaaaactcttcaacacctctatcattattgcctctcagcaacctccaccccaacttctcagcaaaaaaatacatcttctctctctgttcttgactaaacttggttcttgctctctttttcccatgtgggcttgtcattgcgagactgtaactctgtttctggagctgggtatcatcgagatgaccagaatgaccagagctcaaggacaacagcatgtgaggagcaaaagggtagaaagactgcgggcttggtgatgccggtgatgttgggctaggacttgggcctgaacttgttgaccctgggctttggcttg

SEQ ID NO: 17801 - DNA, 486 bp, Populus trichocarpa
  Predicted polypeptide sequence is orthologous to G2997
ttttttttttttttttttgagaaaaaaatagtagtgataattaattaggtcttaaaaagagagtaggaaagagaccactggaaggaattaaagatcaaagtggaacaataataattactagactccaacaggctgaggcggagctgaaggcggaagaggaggaggaggggcctcggcagacactggtggaacaccatctctacggcggtgggcattcttgttattatgcatccaaacctttagcacgtttcttttgataccgacttcgttacagaactgattaagagccatgtcatcatgtttttgtattctccaccctatcttctcagcaaactccaacatcctctctttttgttcctgcgtgaactttgtcctaaacctcttgttactgctgccagaagtactcttcaccataaaccctttccctcctgaccccaccacattcacctcacctctctcaggcgtctctgaccgtcgatcattatc

SEQ ID NO: 17802 - DNA, 366 bp, Populus trichocarpa
  Predicted polypeptide sequence is orthologous to G2998
ttttttttttttttttttcagtaaaaagaaaaaaacattttatttatatttccacatatcctgctagacccatttcaccatccttgttccacaaaatggaccatcaaaccaaccactaatatctaattattaaagaaaattacaacaccatggaaagcatcatcaagcattatctttgcccttactattgacatgataattagaagagaaaaatataaaaaagtagtaaaaacaactgtaaccctagctaattactagcttggcctaccagaagaagctccaccaccaggaccatacatattccctggatgacggtgctgataatggtgatgtcccatcatcgccatacttgactgcatcccaacc

SEQ ID NO: 17803 - DNA, 946 bp, Populus trichocarpa
  Predicted polypeptide sequence is orthologous to G3021
ttttttttttttttttgtataatttaaaggactacagtaccatattcaatactatattgtaaattttacaataagatgtgaaagaaagaaaaaatcacatttagggataatgaggtacagaacctagaagctcccttttatgtccctcctcacaaaaagttccaggtctagctattttagatataccaaccctaaatattacaacaacaatatttatagactaatcagtagactatattgttgaaaaaattaacacgatgatttctgcaaatatatatgaatactggacctagttaatactgtgagtccactaggcaacgaagaatgttcacctgcatctcaagacttgttatataacttcccatgtcgctaaacaattcatcaacgcccatctcattcccacccggcatgagagatcttagactggccagccggcttccgatctgctcttcctcactttgctctgcagcttctttcttgcttctggccctctttaatctcttgttaatcttgggcttaccattagggcttggggaagctctcttttgagaagttacatttggtgaggaatgattatccgcatcgtttttcagaatgcttgggccatgcattgaaagacgtctcaatgaggcatggtgatggatggaagagtcatgaaatctaccagcattcgtattcttgtgaagcctgcttttcaaggctcgactccaagcaaaccctggggcggacatcaccaatgccatgtctacttcatatctcacactttcgtctagctcagaatcatggccataattgtcatctactagcctgcatgtttttatcttcttcagagctggaaccaaatggctcacgtaattcctaacaaacattgtttgcccctatcagcttggctcaagaggatatacacatctccgtttagcactcatctgttcctccatgcaagaag

SEQ ID NO: 17804 - DNA, 815 bp, Populus trichocarpa
  Predicted polypeptide sequence is orthologous to G3032
ttttttttttttttttttacaaactcccacacacatcactttttactatgtttactcacccataattacatgtttacaaaataacataaattaaaaaaaaaactaacaataatttagatacatattccaacatgtaaaaaaaattacaaaacagacccctaaaaatccaagaattgtagaggaggacttctaggaatataggaacagtggcggcgcgtcttctccacgcgtcgccgctgctgccgcaagcgaagcctaaaagatcggtggatctaggatgttttctcctcctctccctttctgcaccggcgatgataaccaccatcacctacaaaagaagaaaaaaaacacaagtttcggttcttcctccctttttttagatctgctctcttttggcttcactctttcttgtggttcgttgttttttttttgtcttctgcaggtgatagatctggcggttgggtagctacaaggctagctctgggctactgttttggtcgttactgttgaggagactagaggagggtgatggctttgttgtggctgatggtgaaggaaatggcggggatctatgggctgctagatctctggtgaagactgtgctcctgcggctaatgagggagatcgtgggtctgtggccgctgaaactgtggtggagatgggagtggctgtctggtcggtttcgggttggtcaggagagaacagggaaaatggggatgagatgcaaacactgggaaggaacggctaagagagggagatctggtgagggactgtctaggctgaaaggggaggcttcttcgggtgtaggggaagaa

SEQ ID NO: 17805 - DNA, 710 bp, Populus trichocarpa
  Predicted polypeptide sequence is orthologous to G3054
ttttttttttttttttttggtggttcgctaccagaaagtgtttctgaggattggtaattggaattggaaggagtgttgtcattaaggccatcagaattattccaaaaacggtagtcatcttctgtggcccaaacagaattggaatcagaggaatttgaaatccagctatctggaccagtaattggaattacatttacaccagaaaaatccctattgtaatccattttataacttaaaaccaactaaacaaatgatattaaagttgaaaactttgaagatgaaaccctaactggtgatgaagatgaaaaaaacagtacataaaacacgaatcccatgaactaaaattgatagaaatgaagcaaggatgtgaaattagcaaaatttgagaaacggatattttaattaacacaccaaggaccgagtaacacagagcttgacctaaaacaacatccggtgcagaaataactgaaattaaagggttttcaattacctgatcaaaggaggaaacttgacattcaattacctgaattcttgaaatgggtttttagttaacacttctaagactagattcaaaagggttttcaataaaacttgcagcgaaaatgagataaatattgaaatacaagtacagcagcagcaggtaaaacctgaaaattcatggataaatgggttttggatccaggggcttgggacatggaggagaatttagc

SEQ ID NO: 17806 - DNA, 795 bp, Populus trichocarpa
  Predicted polypeptide sequence is orthologous to G3055
ttttttttttttttttttaggagctaaatattaaattgggaaattaatccaaagtggtacaactacaaagacaacagatctccttggatacgagacatccagttatcatacttcactacaaagatcaacactataaatgcagtacaagcttcaaatttccacactggaaactcaaattcatgcataaacactacgggtttgacattccaatgagcaagggatcatcctgaaacttcaagccagtaaacatagacctcttcaatctaagggctgaagcttcccaatctcttcaagtctcaagaaaacaaactctgcacttggccatttaaaccttcttgcacgtgtccttgaacattttaaattctatcagaatgctacacaggaaaaaaaaacctgaccctattcaatgtcatcaatccagtcaccatatatcctactgattttgtctggacccttccatttctgatgagttctttgtccaggcctctgaataagaatagatgatttctgtgacggaactccaaggtgataaacatctgaattaggcacagaagtaactgatgcgaccacagtttctggtggagtttttgaaggcactcctccctgctttgactcaacagggacaaaagcagaatcttttgcatccatctccacaagccctccaccgtaacggtgtaactctcctactccatgagcaaagtgacacttattcccaaatgggcaatatccagtaagttcccacttgttacaaattcttgtcttccaatttgatggcttcacattaactgcattgcc

SEQ ID NO: 17807 - DNA, 684 bp, Populus trichocarpa
  Predicted polypeptide sequence is orthologous to G3059
ttttttttttttttttttgcatgaacattactgattaggtttatatacataaccctgggcatttgcttaagctttacaccatccccttttcaatcaatcaatcaagtccaaaattaatccatgcatttttagatgatcaacgaggacccagtagtaacctgtcttggtcagtgagagagtggcgaaagtggcatctgtgtccataaggacaaacccctccagcgagaaccatacggcaagcttgagtcttatatctcgggtgtctgattactggacgtagctcgccaatgccatgagcaaactggcaattgttatcgtaaggacacgtgcctgtctcttgccacttgttgcacagctctgtcttccacatcccctgattaaacacctccaattccattccagcagctatttcctcctctgatctcttcccccctcctcctcctggcacatacaccctctgctgcatctgcatacacgatccagaaacgagttgatcgagctgactcgccacacgagaccgactcgagttactacttgcaccatcgcgaccgcctccattggtgctcacattaccagaaaccgcttgattcaccttcacgtaaccactagatctgacggaaatgctcttcggcaacgtcaccctctctctctcgacattattaacactgttccttctctcaatgg

SEQ ID NO: 17808 - DNA, 666 bp, Populus trichocarpa
  Predicted polypeptide sequence is orthologous to G3059
ttttttttttttttttttgaacgtcatcacgtcaccgacaacggtggttggtgttgtagatgcatcatttgatcaagaaaccagcttcagattggcccgaaatattattagacaacatatgtccaactagcctatatatatatatatatatatatatatatatatatatatatatatataacgtaaccaatttgacagagaaagcaaagaaaaccttacaaccaacttgaaattatgaaagttgcgtagcgaaagaatatcgaaagaatcatcatcattacagatcgagcttcggagtttggtctagtttaggttggtggctggttgttcataaacaatgcctccaagccccacttgaaatatttcctgtcttggtcagtgagggagtggcgaaagtggcatctgtggccatacgggcaaaccccgccagcaagaaccatgcggcaagcttgagtcttgtaccttgggtgcctgataactggacgtagctcgccaatgccatgagcaaactgacaatggttaccataaggacaggtgcctgtctcttgccacttgttgcatagctctgtcttccacatcccttgattaaacacctccaactccattccagcggctatttcctcctccgatctctttttccctcctcctggcacgtacaccctctgc

SEQ ID NO: 17809 - DNA, 508 bp, Populus trichocarpa
  Predicted polypeptide sequence is orthologous to G3060
ggttctctctctctctctctctctctctctgaaccctgccagctttagctgcttctccagaaagaaaacccttatctgggggtgagggtttatgctcctgtttctgtatctcttgtcagattcagggctttaactctttgagttcattacctaattgggattttcgagctcgtttttatttggatctgagatttaaatcgatgatggatacaagaaagagagggagacctgacttcggcactaatggttatggtggattcaagaaatctaagcaagtcgatagttagaagaataagcttgtagtcaagcatttcaatcttttttaattgtcagtactgctggctgtccatttggcgagagctgccactttctccaccatgttcccggtggctacaaggctgtggcccagatggtgaatctgggacctactgttgctttaccgcctgtacctaacagctctgctccgtctgctgttaaaagccggctatgcaaaaaaaaaaaaaaaaaa

SEQ ID NO: 17810 - DNA, 905 bp, Populus trichocarpa
  Predicted polypeptide sequence is orthologous to G3060
ttttttttttttttttttagaatcccaaaatactcaataaccacgccaaataagcaaaggctataacaagagtatgtcctaacacaggaagaagaagaagtagaaagagacaaggtggcaaatgggaggtcacattcccgacttgcgcaattcctcagcaccatgtgcaaaatggcacctatccccaaaagtgcaagatcctttgttaaagttctcacagatcttggtcttgaagttgtttgatccaccagaagagtgcattgcttggttttttatgggaggcccagaggcttgaccgacatttgaaataagctggcgaaccatgtcacttgcttgactgatctgatcaaatgaaccctcgagctctatgctcctctttttagggtctgcctcatgatcccttatggaaagcttggctccagtaacacgacaaatatgcttcgagttaacaccgttttttccaatgatggctccagcaagtgatgcatcaatactgatcttagtagttgcagaggacccaaagctggctgcagcaccatgaccttggtgtggatgctccatgtgtctactcatcctgcctggaattggccccatggcacgaggatcctcatatgatggagcagcagaagccttcccaagctcccactcaccatgggcaaagtggcatttatcaccaaacttgcaaccttcaactgtgttgtatttattgcacaaacgggacttcacagatggaggagaagagcgatcttgataagaaagggttgggacaccttgatttctggatgctggtggaagagctgggctgccaccaacattaagcatctgagacacagctttgaagccaccgggaacataatgcaagaaatggcatccctcaccaaatggacatccagaagtactgaaaa

SEQ ID NO: 17811 - DNA, 939 bp, Populus trichocarpa
  Predicted polypeptide sequence is orthologous to G3060
ttttttttttttttttttcccacaaagaagccctaagttcaacctggcaagatttatcccgagacttcagtaacgatggcagaccaacaaacaaataaacaacaaagagatcataaaaattgcgaaaagaaaaacctagaactcttagagatggcatctgtctatctttgaatcccaaaatacttggtaaccacgccaaacaccaaaggctataacaagagtatgtcctaacacaggaagaagagagacgaggtagtgaaagtgaggtcacattccagacttgcgcaattcctcggcaccgtgtgcaaagtggcacctatccccaaaagtgcaagatcctttgttgaagttctcacagatcttggtcttgaagttatttgatccgccagaagaatgcatcgatgagttcttcatgggaggtccagaggcttgaccgacatttgaaataagctggcgaaccatgtcacttgcttgactgatctgatcaaatgaaccctcaagctctatgttcctctttttagggtctgtttcatgctcccttatggaaagcttggctccagtagcacgacagatatgcttagagttaacaccatttttcccaatgatggctccagcaagtgaagcatcaatactgatcttagtagtagcggatgacccaaagcttgctgcagcaccatgaccttggtgtggatgctccatgtgccgactcatcctgccctgcattggccccatggcacgaggatcatcatatggagcagcagccctgccctgcattggccccatggcacgaggatcatcatatgaagcagcagaagccttcccaagctcccactcaccatgggcaaaatggcatttatcaccgaacttgcaaccctcaactgtgttgtatttattgcacaaacgggacttcacagatggaggagaagagcgatctggaaa

SEQ ID NO: 17812 - DNA, 756 bp, Populus trichocarpa
  Predicted polypeptide sequence is orthologous to G3074
ttttttttttttttttttactggaatatggctaaactaaaacaaagagagttcacataaaacattctcaaactacagctcctactagggctaccccatccttcctgcatcagatagttaagttacacagactatctcacattttcagaaaatctaccactataggaagttgttagagaatggcatcacagaggatgcataaagatgatgacacagaataaaagtagaaattcagaaccagccttttcctagggagaatggacagcgcatatctccgttttccacctagggcatctatgtggttgagccctgctgtttcttctctccttgtctccatgcctattaattgtgttcccaaccactaatcttttctaagagccagctgatagtaagatcagccttcttcatcgtaatcttcctcctcctcgtctaatcttttgctgagctgtgcaagctgaagagggtcaataaccatcttgtccatttcagaaagtgaccaacctggatattcttcatggttagtttcagcagcaggctctactgatgagctgggggctgaggtggtggttgtggttgtggtggcggcggcggcggcggctggtgctgccgcagctggtgctgctgcagcctttgcatcctcactatcattaacctctgcattcagatcaaagtttcgttctggttgattggtagcatcactgactctgttattttccttcactgattccttagactctgagccattgtccatcactac

SEQ ID NO: 17813 - DNA, 863 bp, Populus trichocarpa
  Predicted polypeptide sequence is orthologous to G3074
aaggcgaggacgggggaggggtcgtggacgaggtgctcgaaatatagaaagagagacttctagtcgtgaccttgaatccgaatcctccacaaccattccgcagagtgttaaaaataactcgaatcctgaagtggtgatggacaatggctcagagtcaaaggaatctgtgatggaaaataacatagccagtgatgctgccagtcaagcagaacgaaactttgatcttaatgcagaggttaatgatagtgaggatgcaaaagctgcagcagcaccagctgccgccaccgctgcagccaccgctgcagcagcaccagctgccgccaccgctgcagccaccgctgcagcagcaccagctgccgccaccgctgcagcagcaccagctgccgccaccgctacagcccctagcttatcagcagagcctgctgcagaaactaatcatgaagaatatccaggttggtcactttctgagatggacaagatggctattgacccacttcagcttgcacaactcagcacaagagtagatgaggaggaggaagattatgatgaagaaggatgatcatgctattagctgaggctcttagaaaaagattggtggtcaggatccaattaatgagcgcatggatacaaggagaggaaagaaacagctgggtaagaaccctaggtggagaacggaaatatgctcaatccgttctccaaatagaaacgctgattctgaatctctccttttcttctgtgtgaatctttatgcatcttctgtcatgccattctctaacaacttccagtagtagtagatttgctgacaatatgagattgttagtttgtgtaacttaactatctgatacaggaaggatgggatagcc

SEQ ID NO: 17814 - DNA, 911 bp, Populus trichocarpa
  Predicted polypeptide sequence is orthologous to G3083
ttttttttttttttttttggaattaactcgcaacatcatatattaaactaaaatgccagtgcttgaggacttaaagcacctcatggataatagatagtaaacatagatagattcaatctgaaaatataattaaacattactgcgtatcttgcttatcctgcctctaaaaccgaaatcagtctccccatttcttaattatgtcaacagaacagcaaatatgggtgtaattcatggatgattatccactagtaaatcgcatatcagtggtggacgcggcgtgcccaatcacccttcttaccccagtcatgaaggcgcaagtgcaactcagcagcagcaatcaagaaatgaacggcttggattggagtcaaaatatcgataacacctttaatagttctcacccgtagatcatcagccatctgcaagatttcctgcaatccatcctttctaggtgccagagttgactcaactcgctcttcatcagtacccgtgttctcactcctcaacaactcagtcacctcatgtgctaactccaccatagacgagtctgctacagtttcttgatgctttacatgcttctcagtcagctcgttctcttccctgatagtcttcctctgtaactgatcaactcgggtgagttgactagctgaaaggtcacccaagtcacctgtccccaacccacaaatcaactcatggagttgagcctcaagctgatgacctgactttgagtagagcaagtgaaaagccacagagggccgccacccaccaatccaaagaaaagcatgctcgagagtactagtccatgaaggtgagagcatggataacacatcatctttggcccatcttgacttggctctataataatactcataatgctcaagaacacggttgataagaggctggagggttgcctg

SEQ ID NO: 17815 - DNA, 646 bp, Populus trichocarpa
  Predicted polypeptide sequence is orthologous to G3091
ttttttttttttttttttacattcaaagataaatttttcttatttttattttccatatatatattatatatatatatataaacaccatcctgcaacttagtagtagtagaagtacgattttgaagacaaggagtaaactgtcttttcactacccacttccctagggaacccacccaccaaaaccctatttacattttgttttccttgaagcccaaaacttatgtataatcactctagcaagcacctctattctttctttcttaataaaataaaaaaaggcttgctttcttttattcttgccatccagtcctttcacattggtgttattttcttctttcccgtattctatttgctgctgctgctgctgctgcttcatcatatatacaatacatcaccatagatatagagctgaaacctccattactggtccctttctgtcaagagctctaagcacggggttggagaagaggggcaatgagataacaaacatgtatacatgagggtgatctaataatttttgctaaagcatcagtgttctaatattctattatcagtcctcccattggggctcggtgggggattccctttcttcgctttgccgtccggtaactagctggtgttggaggtggtgtggaaggagagaagc

SEQ ID NO: 17816 - DNA, 907 bp, Populus trichocarpa
  Predicted polypeptide sequence is orthologous to G3091
ttttttttttttttttttttaattaaaaatctcttatcttcattttcctttttatataaacaccatcatcgttccagacaagtagccgaaaccattttcaaaccagggagtacattgtcttttcactgcctctttccttagcgacccacctacccaccaaaaccctatttacattttcctttttcttgaagcccagacttatgtataacaacccccactgttctctcctttttatctctctttttttatatataatataaatagcaaaagccttggcttcttattcttaccatccagtccttcacattcatgttattttcttctatgtgctgtagcagtactacttcttcttatatacacatcaacattgacttagggctaaaacctccaatactggtccctctctgtcagaagagagctgtgcaagcatggggtttggagaagaggggcatttagataacaaacttgtatatatgggggtgatctaatatctttgctaaaacatcatcagtgttctaatattctattattagtcctcccattggggctcggtgggggattccctttcttcgctttgctgcccggtgactagcaggcgttggaggtggtgtagagggggagaagctctgcactttgttgtcattgttcttcgtcttcatgtactgcccatgactgctgctgctgctataagagtcctccgaatccgatgccatggacatttgttgtttcttcctcttctggaagttctttgaagtaccaacaatcttgcacccaagagagcagaagcggaaggaatcgaggaggctgcgctcgcagacctcgcaggtgttggttacaccttttccaggccttggctgaggcctctcgttcaaaaacacaactctagcactgttgataacataagttt

SEQ ID NO: 17817 - DNA, 787 bp, Populus trichocarpa
  Predicted polypeptide sequence is orthologous to G3091
ttttttttttttttttttgctttgccgtccggtaactagctggtgttggaggtggtgtggaaggagagaagctctgcactttgttctcattgttgatgttgttcttcttcatgtacctcgcgtggctgctgctactactataagagtcctcagaatccgacgccattgacatttgttgcttctttctcttctggaagttctttgatgtcccaacaatcttgcacccaagagagcagaagcggaaggaatcgaggaggctgcgctcgcagacctcacaggtgttggtaacaccttttccaggcctaggctgaggcctctcattcaaaaacacaactcttgcactgttgataacataagtttgaacaccagagatgtccagcaccttctgtatttcagatacccttatcacatcatgatatgaagacctccgtatctgaatagcatggtggtccttgtggtaggcaagacagagagagcaaagcgcaccattcatacaatccatacaatacatattgcactcactcttgtgtgaatcagcgtgctgcttgcattgaacaaagaacctctctctcaacaaaggtttaagccatggcggccacctgttgtcctcatcatcaggtcctccagctcccattattctcctgttcttgggcttcatagtggtttcttgattttcgatcgccagcttgaatgagtgtatagagaaacagagcactcttagttttagagaaattgaagaaaatgagcgaattcgtcctggtttgtccaaagtaggggggcagagggc

SEQ ID NO: 17818 - DNA, 891 bp, Populus trichocarpa
  Predicted polypeptide sequence is orthologous to G3091
ttttttttttttttttttacgaggcaggcaatgtgtatatatatgaactccacgttcgtttcttttcttcttcttctttttaaacagtacaaaactaacatttacatattggaattgccaagaggtacgtacccaaaacacgaaaaatactcctaatctttcacatatatatgttaacatcactgacttcttttgctttccgcccatcctgttcattccaatctctctctagatcacttatttcttttgatctgtataaacacaaactacattgagtgcacaacaccggcctcttggcacaaaggctcagatgcttacaactttgtgacgtaaagagagagtgatgattttgataacagtttggcaaagtaatcttctttttgatcactactatacatattgacatatattttgttgttgtctccactagtattctatgatgaatcctcccattggagatctctgtggaactccctttcttctcttggcagtcctataattcatcgcagttggcggtggggttgagggtgtaaagctttgtgctttgcttttagcacttccgttgctgatgccactcattgatttttcagtgtctggaccatccatctccttgtaccttttcttcttcctgaaattctttgatgtcccaacaatcttgcaagcaagagagcagaagctgaatgaatcaaggaggctgcgctcacagacatggcaagtgttggtaacacctttaccaggcctaggctgaggcctctcattcaagaacacaatttttgcactgttgatgatgtaggtctggacctctgttatgtccaagtatttctgaatttcagacaccctaatcacatcatggtaagatgacctccttatctggatagctctatggtcttt

SEQ ID NO: 17819 - DNA, 852 bp, Populus trichocarpa
  Predicted polypeptide sequence is orthologous to G3095
ttttttttttttttttttggtttatgaaatcttaaaatggggcacgatgaggtataccctttcttctccttgcatttcgatgattgaaaatgggaggagtagccggagaaatgttggtagctgcatcatcaccggagctctccgcgccatcattattagaggaatagattgagagtccctccatcaaacgattgaaagcatgtgtcctgcgaatcttcttaggggtcgaggactcatctgattctgacccaccaaagaagggatccctattgtgcttcaattttaccgcaaatgtaaggtctgggtcaccccgcttcatccctcccagcttgcatccaagtgaacagaatctgaaagaatcaaggagacttcgacaacaaatttcacaagtgttggtgactccctttcccggccttggctgagggcgctcgttgaggaacacaatcttggcgctattgatgatgtaagtctgcacgcatgatatgtctatgtacttctgtatctcatttaccctcaccacgttatggtatgaagatcgccttatctgaacaacacggtggtctttgtgataaatgagacaatacgaacagaaagcatttcccatacaatctaagcagaacatattgcattcgcttttattggattcaccatgaactccacagggaatgaaatagcttgctctaagcatgggtatcaaccatggtggacccatgtcgtggttccccatttgcccaaatgaactcaccatgactttgttattactattagtttcgatgaaaatccaatcttctacagcctctgctcctgttgattatagataataaacagctgccaaaagaacgaaaagcaatc

SEQ ID NO: 17820 - DNA, 851 bp, Populus trichocarpa
  Predicted polypeptide sequence is orthologous to G3111
ttttttttttttttttttggaaagtaagaactgctattccattgaactattcttgatcagattctagtttacaactgaaactaacaaaactgccaagaacacaaccatgttgacgggaaaatgaaaaacaagtgactcatggaatatttagagcaacgaactttctgggagttgttccaacggcttatgaattccaacttctttcactctaaatactcatatttggactctctgatattggaaatcctaatgaatgcagcttaaaatttgactcttctgaaggatttagggatttgacgggctttctacatgcttgtctcctgtgtcttttgcaatctgagtactctcggttaaggggggtgaattctccccacatgcttcatcaccatcagatgcacaaagattatcttgaatggtgtccatcccatggctgtcgtctgatctttgtgaaatcccacgcccggtcaacaaatagttataagaatgggaatcaaaggtctctgtgccatattgagaacggatagctgaactgaacaagggttgcatcacgcacttcttctcgggaaattcacgtaatgatattcgacacatgggacaagtggaatgctgttgcaaccacatgtctatgcaggtcacgtggaaggagtgcccacagtaggggagaatacgcaatatatctttgccatggtattctgcaaggcaaactgtgcactgagcatcttctgaagccgagaaaagcttatcgttgtacttcttggttggaaagctagctataactacaggctcaagaccatgtaaacctcgttccaacatgctaagatcagatctggaagcaatacgaaaagatcgtc

SEQ ID NO: 17821 - DNA, 909 bp, Populus trichocarpa
  Predicted polypeptide sequence is orthologous to G3967
atattggatttaattgcagtgcacaagttctattaagatcagtgcttccagagaagcaagagttatgtttctctgttgtttctctgttgtggcacaagctaattgcatcacctgaaactcaaccttgtgcagaaagcacttctgctcaacaaggatggagacaggttgtggacgcactatgcaatgttgtatcagcatcgccagcaaaagcagctacagcagttgttcttcaggcggagagggaattgcaaccttggattgccaaagatgatgatgatttaggtcagaagatgtggagagtcaatcagcgcatcgtcaagttgattgttgagctgatgagaaatcatgatacctcagaatctttggtaattttggctagttcatcagatctacttttacgtgccacagatgggatgcttgttgatggagaagcatgcactttaccacagcttgagctactggaagcaacagctagagcagttcagccagtgctggagtggggagagtctggacttgcggttgcagatggcctttcaaacatcttaaagtgtcgtctaccagctactatccgatgcctttctcatccaagcgctcatgtccgtgctctgagcacatctgttcttcgtgatattcttcaaactggctcaataaaaccctcttccaagcaaggggacaggaatggaatccatggaccctcttatcaatatttcagcctggataaaatcgactggcaagctgatattgaaaagtgcttaacctgggaagctcgtagccgacttgccacaggaatgcccattcatcatcttgacactgctgccaaggagttaggctgtactatttccatttgacgtcttagcttatggcaaccatttcaggtttatcattacgctttccatgagtgagactttc

SEQ ID NO: 17822 - DNA, 923 bp, Populus trichocarpa
  Predicted polypeptide sequence is orthologous to G3967
ttttttttttttttttgagaaaaaaataaattatcttcatatccatacccttttttctcttactctttgggtatcagaatttatttccatggcttgatgtccttgttttctgctctgaatgggaaaaagggtcatttctttgaaggccatgtcttggttcagagttccaagcagaaccagggataagtagttattgttcttgcaaccagagactaaactaagatcaacagtggacagaaatacaaaaacaatcaagttctggaaactcagatagaacccgatgccttctcaacctatgctatggaaattcagatagaacctgtcccctctgctgtacaccaatctgacttgtcccctctgctgtacaccaatctgttgaaggaaacctaaaccatccatgttgaactttggcgtgaaaataggtatctattcgaactagataaaattaatatggccgtgttgatttgtttcactatacactgttatacctcaggttttaaacctagaacaaagtgaaagttaattctctggccatcagatccttcaatcaacttaacatggtctacttatatctgtaagtctcactcatggaaagagcaatgataaaacctgaaatggctggcaagagctcatcaatgttaaatggaaatagtacagcctaactccttggcggcagtatcaagatgatgaacaggcattcctgtcgcgagtcggctatgggcttcccatgttaggcacttttctatatcagcttgccagttgatgacatctgatctgagatattgataagagggtccatggattccattcctgtgtgtgagtttagaagcgggttttatggaaccagtatgctgaatatcacgaagaacagatgtgctcagagcacggacatgagcacttggatgagaaaggcatcgtatagt

SEQ ID NO: 17823 - DNA, 689 bp, Populus trichocarpa
  Predicted polypeptide sequence is orthologous to G3967
ttttttttttttttttttggtctcttgctcccacgggaatgagcttcgtgactgacacacacagttaacacaacaaatagtagtcgcgatgcaagctctactgaggcacatgattctagaaagagtgagtggaccatagtacgaagctctgccacagcaaggtttttggaggcaggccctaagctagaaaaatatcttgttcttctggtctgttctctagaagcctccggcggaaatgttctctgaagaattgcttccacagtggcaacaaatatcttcatgaggcatgcttcggatggacttccacgtggaagatattccaggaccttaaggagaggtatatacagattccatgacaataatggaggttgcaatggtgttgcaactatgatttcaggaagatcaactgctgaggaacttaaaggaatcagaccataagcagcttcccaaatggtacaaattctccattcaacctcaggtccatgggcacaaagcatggatgcaattccctgggcagttgcttcaatagtcgcttcagctgcaggcacttctatctgcttcctgtagcatgaaatgtaaccacccaaaggttcatgttgaacttccaccccttcaacttgccttagtggaggaaaaagcaatgcaggctgtgagagaatgcggaaaagtaaagctgcagctgcgtcagc
